US008399627B2

(12) United States Patent
Votsmeier et al.

(10) Patent No.: US 8,399,627 B2
(45) Date of Patent: Mar. 19, 2013

(54) ANTIBODIES TO TNFα

(75) Inventors: Christian Votsmeier, Köln (DE); Uwe Gritzan, Köln (DE); Kornelia Kirchner, Frechen (DE); Michael Strerath, Köln (DE); Kerstin Baral, Mannheim (DE); Ulrich Haupts, Odenthal (DE); Wayne M. Coco, Pulheim (DE); Susanne Steinig, Köln (DE); Andreas Scheidig, Köln (DE); Klaus Pellengahr, Berlin (DE); Simone Brückner, Köln (DE); Hanna Plittersdorf, Köln (DE); Peter Scholz, Köln (DE); Jan Tebbe, Köln (DE)

(73) Assignee: Bayer Pharma AG, Berlin (DE)

( * ) Notice: Subject to any disclaimer, the term of this patent is extended or adjusted under 35 U.S.C. 154(b) by 105 days.

(21) Appl. No.: 12/808,608

(22) PCT Filed: Dec. 24, 2008

(86) PCT No.: PCT/EP2008/011120
§ 371 (c)(1),
(2), (4) Date: Aug. 6, 2010

(87) PCT Pub. No.: WO2009/083246
PCT Pub. Date: Jul. 9, 2009

(65) Prior Publication Data
US 2010/0297700 A1 Nov. 25, 2010

Related U.S. Application Data

(60) Provisional application No. 61/018,436, filed on Dec. 31, 2007.

(51) Int. Cl.
C07K 16/24 (2006.01)
A61K 39/00 (2006.01)
(52) U.S. Cl. .................... 530/387.9; 424/139.1
(58) Field of Classification Search .......... None
See application file for complete search history.

(56) References Cited

U.S. PATENT DOCUMENTS 5,231,024 A 7/1993 Moeller
6,090,382 A * 7/2000 Salfeld et al. .............. 424/133.1

FOREIGN PATENT DOCUMENTS

| EP | 218868 | 4/1987 |
| EP | 186833 | 8/1992 |
| WO | WO 2004016286 | 2/2004 |
| WO | WO 2006014477 | 2/2006 |

OTHER PUBLICATIONS

Brocks et al., "Generation and optimization of human antagonistic antibodies against TIMP-1 as potential therapeutic agents in fibrotic diseases," Human Antibodies 15, 115-24, 2006.
Cvetković & Scott, "Adalimumab: a review of its use in adult patients with rheumatoid arthritis," Biodrugs 20, 293-311, 2006.
Shen et al., "A fully human anti-TNF mAb adalimumab (D2E7) induces caspase-dependent apoptosis of human peripheral blood monocyte and T cells," Gastroenterology. 2004;126(suppl 2):A-153.
Steidl et al., "In vitro affinity maturation of recombinant antibodies by combination of pre-selected CDR-library pools," IP.com, Inc; Oct. 16, 2007.
Wark & Hudson, "Latest technologies for the enhancement of antibody affinity," Adv Drug Deliv Rev. Aug. 7, 2006;58(5-6):657-70. Epub May 22, 2006.
International Search Report for PCT/EP2008/011120 dated Apr. 21, 2009.
Dernfalk et al., "Commercially Available Antibodies to Human Tumour Necrosis Factor-α Tested for Cross-Reactivity with Ovine and Bovine Tumour Necrosis Factor-α using Flow Cytometric Assays," *Acta Vet. Scand.* 45, 99-107, 2004.
Hahn et al., "Use of monoclonal antibodies to a human cytotoxin for its isolation and for examining the self-induction of resistance to this protein," *Proc. Natl. Acad. Sci. USA* 82: 3814-18, 1985.

* cited by examiner

*Primary Examiner* — Elly-Gerald Stoica
(74) *Attorney, Agent, or Firm* — Banner & Witcoff, Ltd.

(57) ABSTRACT

Provided herein are antibodies, antigen binding portions, and derivatives thereof that are capable of binding tumor necrosis factor alpha (TNFα); nucleic acids encoding the antibodies, antigen binding portions, and derivatives thereof, including complementary nucleic acids; vectors; and host cells containing the nucleic acids.

12 Claims, 56 Drawing Sheets

Fig.1:

Heavy Chain (SEQ ID NO. 1):
EVQLVESGGG LVQPGRSLRL SCAASGFTFD DYAMH$^1$WVRQA PGKGLEWVSA ITWNSGHIDY
ADSVEG$^2$RFTI SRDNAKNSLY LQMNSLRAED TAVYYCAKVS YLSTASSLDY$^3$ WGQGTLVTVS
SASTKGPSVF PLAPSSKSTS GGTAALGCLV KDYFPEPVTV SWNSGALTSG VHTFPAVLQS
SGLYSLSSVV TVPSSSLGTQ TYICNVNHKP SNTKVDKKVE PKSC

Light Chain (SEQ ID NO. 2):
DIQMTQSPSS LSASVGDRVT ITCRASQGIR NYLA$^1$WYQQKP GKAPKLLIYA ASTLQS$^2$GVPS
RFSGSGSGTD FTLTISSLQP EDVATYYCQR YNRAPYT$^3$FGQ GTKVEIKRTV AAPSVFIFPP
SDEQLKSGTA SVVCLLNNFY PREAKVQWKV DNALQSGNSQ ESVTEQDSKD STYSLSSTLT
LSKADYEKHK VYACEVTHQG LSSPVTKSFN RGEC

1:CDR-1    2:CDR-2    3:CDR-3

Fig.2:

| chain | CDR | amino acid number | wild-type | URS_1.12_50 | URS_1.12_87 | URS_1.12_103 | URS_1.12_47 | URS_1.12_84 | URS_1IIL_1.12A_7.0_1 | URS_1IIL_1.12A_20.1_2 | URS_1IIL_1.12A_11.2_2 | URS_1IIL_1.12A_15.0_2 | URS_1IIL_1.12_6.5_2 | URS_1IIL_1.12_2.3_1 | URS_1IIL_1.12A_11.3_1 | URS_1IIL_1.13_12.2_2 | URS_1.42a_22_2_x2 | URS_1.42a_105_1_x2 |
|---|---|---|---|---|---|---|---|---|---|---|---|---|---|---|---|---|---|---|
| Heavy Chain | CDR1 | 31 | D | H | G | G | D | T | Q | N | H | N | N | G | N | Q | H | R |
| Heavy Chain | CDR1 | 32 | Y | F | F | Q | S | F | Y | S | Y | S | F | F | Y | Y | Y | Y |
| Heavy Chain | CDR1 | 33 | A | A |  | A | A | A | A | A | A | A | A | A | A | A | A | A |
| Heavy Chain |  | 40 | A | A | A | A | A | A | A | A | A | A | A | A | A | A | V | A |
| Light Chain |  | 129 | T | T | T | T | T | T | T | T | T | T | T | T | T | T | A | T |
| Light Chain |  | 166 | Q | Q | Q | Q | Q | Q | R | Q | Q | Q | Q | Q | Q | Q | Q | Q |
| Light Chain |  | 180 | T | T | T | T | T | T | T | T | T | T | T | T | T | I | T | T |

| chain | CDR | amino acid number | wild-type | URS_1oIL1.19_29.3_2 | URS_1oIL1.19_29.5_1 | URS_2.1cIL1.15_12.1_ |
|---|---|---|---|---|---|---|
| Heavy Chain | CDR2 | 50 | A | A | A | G |
| Heavy Chain | CDR2 | 58 | I | T | V | I |

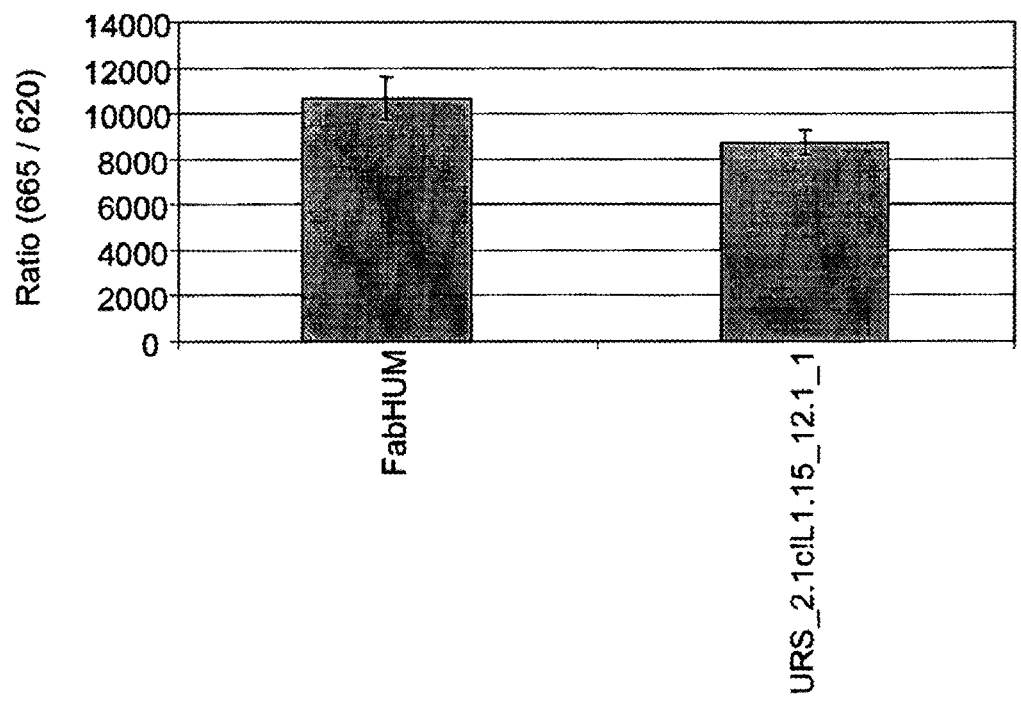

Fig.8:

| chain | CDR | amino acid number | wild-type | URS_1blL1.29_11.2_2 | URS_1blL1.29_10.2_2 | URS_1blL1.29_12.5_1 | URS_1blL1.29_11.7_1 | URS_1blL1.29_11.1_1 | URS_1blL1.29_11.3_1 | URS_1qlL1.31_38.5_1 | URS_1qlL1.31_38.6_2 | URS_1qlL1.31_38.4_1 | URS_1qlL1.31_24.6_2 | URS_1qlL1.31_19.3_1 | URS-1elL1.30_15.3_2 | URS_1hlL1.30A_11.0_ | URS_1hlL1.30_4.3_1 | URS_1hlL1.30A_23.1_ | URS_1.61_H1_26 | URS_1.63a_10_1 | URS_1.63a_22_1 | URS_1.63a_33_2 |
|---|---|---|---|---|---|---|---|---|---|---|---|---|---|---|---|---|---|---|---|---|---|---|
| Light Chain | CDR1 | 24 | R | L | A | L | T | R | L | R | R | R | R | R | R | R | R | R | R | R | R | R |
| Light Chain | CDR1 | 25 | A | S | A | S | A | S | G | A | A | A | A | A | T | A | A | A | A | A | A | A |
| Light Chain | CDR1 | 26 | S | S | S | S | S | S | S | S | S | S | S | S | S | S | T | S | S | S | S | S |
| Light Chain | CDR1 | 27 | Q | Q | Q | Q | Q | Q | Q | Q | Q | Q | Q | Q | L | M | Y | Y | Q | V | W | K |
| Light Chain | CDR1 | 28 | G | G | G | G | G | G | G | S | P | P | R | G | G | G | G | G | L | G | G | G |
| Light Chain | CDR1 | 29 | I | L | I | I | I | I | I | L | V | L | V | L | I | I | I | I | I | I | I | I |

Fig.9A:

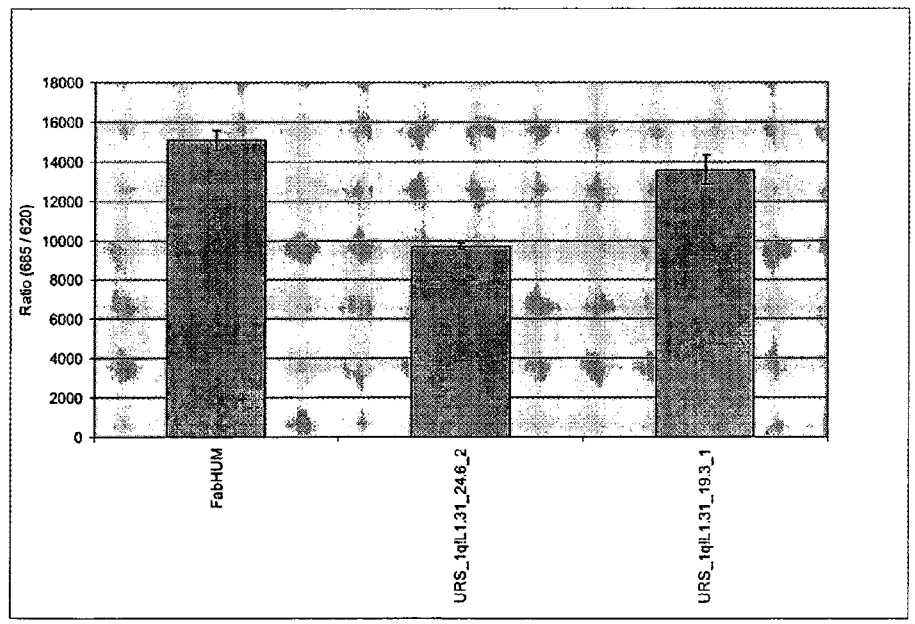

Fig.10:

| chain | CDR | amino acid number | wild-type | URS_1.clL1.39_14.0_1 | URS_1.clL1.35_13.6_1 | URS_1.clL1.35_13.3_1 | URS_1.49_II_A3 | URS_1.49_I_D3 | URS_1.49_I_G8 | Urs1.49a_159_2 | URS_1.49a_56_2 | Urs1.49a_112_2 | URS_1.49a_92_1 | URS_1.49a_154_1 | URS_1kIL_1.22_11.3_1 | URS_1.52a_160_2 | URS_1.50a_71_2 | URS_1mIL1.35_20.6_1 | URS_1mIL1.36_12.6_2 | URS_1mIL1.36_12.1_1 | URS_1q!L1.36_20.0_2 | URS_1.62a_112_2 |
|---|---|---|---|---|---|---|---|---|---|---|---|---|---|---|---|---|---|---|---|---|---|---|
| Heavy Chain |  |  | A | A | A | A | T | A | A | A | A | A | A | A | A | A | A | A | A | A | A | A |
| Heavy Chain |  |  | A | A | A | A | A | A | S | A | A | A | A | A | A | A | A | A | A | A | A | A |
| Heavy Chain | CDR2 | 65 | E | E | E | E | E | E | E | E | E | E | E | E | R | E | E | E | E | E | E | E |
| Heavy Chain | CDR2 | 66 | G | G | G | G | G | G | G | G | G | G | G | G | N | G | G | G | G | G | G | G |
| Light Chain | CDR2 | 52 | S | W | G | N | S | S | S | S | S | S | S | S | S | S | S | N | S | S | S | N |
| Light Chain | CDR2 | 53 | T | W | W | W | Y | W | G | Y | F | F | S | V | S | T | T | W | T | T | T | Y |
| Light Chain | CDR2 | 54 | L | L | L | L | L | L | L | L | L | L | L | L | L | L | S | L | T | T | T | L |
| Light Chain | CDR2 | 55 | Q | Q | Q | Q | Q | Q | Q | Q | Q | Q | Q | Q | Q | Q | Q | I | K | L | Q | Q |
| Light Chain | CDR2 | 56 | S | S | S | S | S | S | S | S | S | S | S | S | S | R | S | S | S | S | S | S |
| Light Chain |  | 57 | G | G | G | G | G | G | G | S | G | G | G | G | G | G | G | G | G | G | G | G |
| Light Chain |  | 214 | C | C | C | C | C | C | C | C | C | C | C | C | G | C | C | C | C | C | C | C |

Fig.11A:

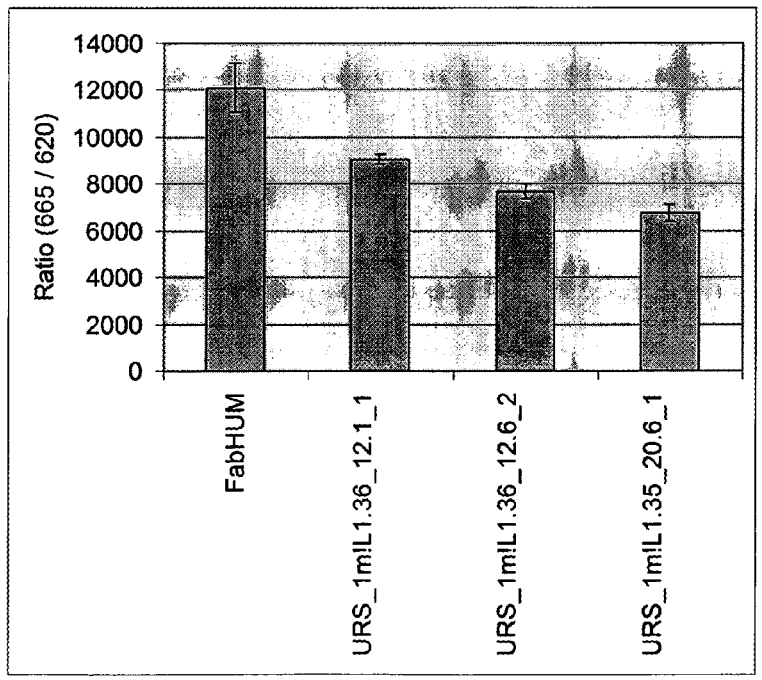

| chain | CDR | amino acid number | wild-type | FAB-02 | URS_1.clL1.40_15.3_1 | URS_1.clL1.40_7.0_1 | URS_1.clL1.40_15.21_1 | URS_1.clL1.40_15.20_1 | URS_1.clL1.40_15.25_1 | Urs1.clL1.40_15.14_1 | Urs1.clL1.40_7.5_1 | URS_1.64a_65_1 | URS_1.57a_123_2 | URS_1.57a_68_1 | URS_1.57a_98_2 | URS_1.57a_116_2 | URS_1.57a_17_1 | URS_1.57a_56_2 | N92I | R93K | R93Q | R93M |
|---|---|---|---|---|---|---|---|---|---|---|---|---|---|---|---|---|---|---|---|---|---|---|
| Light Chain | | 15 | 15 | V | V | V | V | V | V | V | V | V | V | V | V | M | V | V | V | V | V | V |
| Light Chain | CDR3 | 92 | 92 | N | I | N | N | N | N | N | D | D | N | N | N | N | N | N | I | N | N | N |
| Light Chain | CDR3 | 93 | 93 | R | Q | K | R | M | Q | K | M | R | R | R | R | R | R | R | K | Q | M |
| Light Chain | CDR3 | 94 | 94 | A | P | P | P | P | P | S | A | A | P | P | P | P | P | P | A | A | A | A |
| Light Chain | CDR3 | 95 | 95 | P | P | P | P | P | P | P | P | P | Q | A | S | M | E | V | P | P | P | P |

Fig.14:

| chain | CDR | amino acid number | wild-type | URS_2.1a_12.5.1 | URS_2.1a_6.2.1 | URS_2.1a_8.1.1 | URS_2.1a_12.7.1 | URS_2.1b_9.0.1 | URS_2.1b_5.5.1 | URS_2.1b_13.5.1 | URS_2.1b_25.6.1 | URS_2.1b_9.2.1 | URS_2.1b_6.4.2 | URS_2.1c_33.7.1 | URS_2.1c_32.1.1 | URS_2.1c_33.3.1 | URS_2.1c_31.0.1 | URS_2.1c_34.2.1 | URS_2.1c_34.5.1 | URS_2.1c_30.1.1 | URS_2.1c_34.3.1 | Urs_2.1Amp_H2_13.20 | URS_2.1Amp_H3_16.2 | URS_2.1Amp_H3_20.2 | Urs_2.1Amp_H3_5.22 | Urs_2.1Amp_H3_4.87 | URS_2.1Amp_H2_3.72 | URS_2.1Amp_H2_11.8 | URS_2.1Amp_H3_6.21 | URS_2.1Amp_H3_15.2 | URS_2.1Amp_H2_17.5 | URS_2.1Amp_153 | URS_2.1Amp_68 | URS_2.1Amp_53 |
|---|---|---|---|---|---|---|---|---|---|---|---|---|---|---|---|---|---|---|---|---|---|---|---|---|---|---|---|---|---|---|---|---|---|
| Heavy Chain | | 3 | Q | Q | Q | R | Q | Q | Q | Q | Q | Q | Q | Q | Q | Q | Q | Q | Q | Q | Q | Q | Q | Q | Q | Q | Q | Q | Q | Q | Q | Q | Q | Q |
| Heavy Chain | CDR1 | 31 | D | H | H | G | D | Q | Q | Q | D | Q | Q | Q | H | N | Q | D | Q | H | Q | Q | Q | Q | Q | D | G | Q | Q | Q | Q | Q | G | D |
| Heavy Chain | CDR1 | 32 | Y | Y | Y | S | F | F | F | F | S | Y | Y | F | F | Y | F | S | Y | F | F | F | Y | Y | Y | S | F | Y | Y | Y | Y | Y | F | S |
| Heavy Chain | CDR1 | 34 | M | M | M | M | M | M | M | M | M | M | M | M | M | M | M | M | M | M | M | M | M | M | M | M | M | M | M | M | M | M | I | M |
| Light Chain | | 49 | Y | Y | Y | Y | Y | Y | Y | Y | Y | Y | Y | Y | Y | Y | Y | Y | Y | Y | Y | Y | Y | Y | Y | Y | S | Y | Y | Y | Y | Y | Y | Y |
| Light Chain | CDR2 | 52 | S | N | G | N | N | S | G | G | W | G | G | G | G | G | G | G | G | G | S | G | S | G | G | G | G | G | G | S | G | G | G | S |
| Light Chain | CDR2 | 53 | T | T | W | W | W | W | W | W | W | W | T | W | W | W | W | W | W | W | W | W | W | W | W | W | W | W | W | W | W | T | W | T |
| Light Chain | | 58 | V | V | V | V | V | V | M | V | M | V | V | V | V | V | V | M | V | V | V | V | V | V | V | V | V | V | V | V | V | V | V | V |
| Light Chain | CDR3 | 92 | N | I | I | N | I | I | N | I | N | I | I | N | I | I | I | N | I | N | N | I | I | N | N | I | N | N | I | N | I | I | I | N |
| Light Chain | CDR3 | 93 | R | K | Q | K | Q | Q | R | Q | K | R | Q | R | Q | K | Q | Q | R | R | R | Q | Q | Q | K | Q | Q | Q | Q | M | K | Q | Q | R |
| Light Chain | CDR3 | 94 | A | P | P | P | P | P | A | A | P | P | P | P | P | P | P | P | A | P | A | A | A | A | A | P | A | P | P | P | P | P | A | P |
| Light Chain | | 196 | V | V | V | V | A | V | V | V | V | V | V | V | V | V | V | V | V | V | V | V | V | V | V | V | V | V | V | V | V | V | V | V |

Fig.16:

SEQ ID NO. 3
gaagtgcagctggtggaaagcggcggcggcctggtgcagccgggccgcagcctgcgcctg
agctgcgcggcgagcggctttacctttgatgattatgcgatgcattgggtgcgccaggcg
ccgggcaaaggcctggaatgggtgagcgcgattacctggaacagcggccatattgattat
gcggatagcgtggaaggccgctttaccattagccgcgataacgcgaaaaacagcctgtat
ctgcagatgaacagcctgcgcgcggaagataccgcggtgtattattgcgcgaaagtgagc
tatctgagcaccgcgagcagcctggattattgggccagggcaccctggtgaccgtgagc
agcgcgagcaccaaaggcccgagcgtgtttccgctggcgccgagcagcaaaagccaccagc
ggcggcaccgcggcgctgggctgcctggtgaaagattattttccggaaccggtgaccgtg
agctggaacagcggcgcgctgaccagcggcgtgcataccttccggcggtgctgcagagc
agcggcctgtatagcctgagcagcgtggtgaccgtgccgagcagcagcctgggcacccag
acctatatttgcaacgtgaaccataaaccgagcaacaccaaagtggataaaaaagtggaa
ccgaaaagctgc SEQ ID NO. 4
gatattcagatgacccagagcccgagcagcctgagcgcgagcgtgggcgatcgcgtgacc
attacctgccgcgcgagccagggcattcgcaactatctggcgtggtatcagcagaaaccg
ggcaaagcgccgaaactgctgatttatgcggcgagcaccctgcagagcggcgtgccgagc
cgctttagcggcagcggcagcggcaccgatttttaccctgaccattagcagcctgcagccg
gaagatgtggcgacctattattgccagcgctataaccgcgcgccgtataccttggccag
ggcaccaaagtggaaattaaacgcaccgtggcggcgccgagcgtgtttatttttccgccg
agcgatgaacagctgaaaagcggcaccgcgagcgtggtgtgcctgctgaacaacttttat
ccgcgcgaagcgaaagtgcagtggaaagtggataacgcgctgcagagcggcaacagccag
gaaagcgtgaccgaacaggatagcaaagatagcacctatagcctgagcagcaccctgacc
ctgagcaaagcggattatgaaaaacataaagtgtatgcgtgcgaagtgacccatcagggc
ctgagcagcccggtgaccaaaagctttaaccgcggcgaatgc

Fig. 17:

| | CDR | amino acid number | wild type | URS_1.66a_11_1 | URS_1.66a_25_1 | URS_1.66a_33_1 | URS_1.66a_43_1 | URS_1.66a_51_1 | URS_1.66a_133_1 |
|---|---|---|---|---|---|---|---|---|---|
| Light Chain | CDR2 | 55 | Q | E | G | V | T | R | S |
| Light Chain | CDR2 | 56 | S | R | R | R | R | R | R |
| Light Chain | | 58 | V | V | V | V | V | M | V |

| | CDR | amino acid number | wild type | URS_1.67a_16 | URS_1.67a_76 | URS_1.67a_80 | URS_1.67a_106 | URS_1.68a_41 | URS_1.68a_122 | URS_1.68a_154 |
|---|---|---|---|---|---|---|---|---|---|---|
| Heavy Chain | | 30 | D | D | D | D | D | G | G | R |
| Heavy Chain | CDR1 | 31 | D | D | D | D | D | D | D | D |
| Heavy Chain | CDR1 | 32 | Y | Y | Y | Y | Y | Y | Y | Y |
| Heavy Chain | | 219 | V | V | M | V | V | V | V | V |
| Light Chain | | 15 | V | V | V | V | V | V | M | V |
| Light Chain | CDR1 | 24 | R | R | R | R | R | R | R | R |
| Light Chain | | 49 | Y | R | R | V | W | Y | Y | Y |
| Light Chain | | 58 | V | V | V | M | V | V | V | V |

Fig.21:

| | CDR | amino acid number | wild type | URS_2.1b_39.1_1 | URS_2.1f_28.5_2 | URS_2.1f_8.6_1 | URS_2.2b_10.7_1 | URS_2.2b_33.3_1 | URS_2.2b_25.6_2 | URS_2.2d_181 | URS_2.2d_229 | URS_2.2d_218 | URS_2.2d_165 | URS_2.2d_162 | URS_2.2d_282 | URS_2.2d_291 | URS_2.2d_303 | URS_2.2d_251 | URS_2.2d_287 | URS_2.2e_139 | URS_2.2e_182 | URS_2.2e_289 | URS_2.2e_418 |
|---|---|---|---|---|---|---|---|---|---|---|---|---|---|---|---|---|---|---|---|---|---|---|---|
| Heavy Chain | | 1 | E | E | E | E | E | E | E | E | E | E | E | E | E | E | E | E | E | E | E | E | K |
| Heavy Chain | | 5 | V | V | V | V | V | V | V | V | I | V | V | V | V | V | A | V | V | V | V | V | V |
| Heavy Chain | | 28 | T | T | T | T | T | T | T | T | T | T | T | T | T | S | T | T | T | T | T | T | T |
| Heavy Chain | CDR1 | 31 | D | Q | Q | Q | Q | Q | Q | H | Q | Q | G | Q | Q | Q | Q | Q | Q | Q | H | H | H |
| Heavy Chain | CDR1 | 32 | Y | F | Y | Y | F | F | F | F | Y | F | Y | F | F | Y | F | F | F | F | F | R | F |
| Heavy Chain | | 39 | G | G | G | G | G | G | G | G | G | G | G | G | G | G | G | G | R | G | G | G | G |
| Light Chain | | 5 | T | T | T | T | T | T | T | T | T | T | T | T | T | T | T | T | T | S | T | T | T |
| Light Chain | CDR2 | 52 | S | G | N | N | S | N | S | S | W | S | G | S | G | W | S | N | N | N | S | N | S |
| Light Chain | CDR2 | 53 | T | W | W | W | W | T | T | T | W | W | W | T | T | W | W | W | T | T | T | W | T |
| Light Chain | | 80 | P | P | P | P | P | P | P | P | P | P | P | P | P | P | P | P | P | P | P | P | Q |
| Light Chain | CDR3 | 92 | N | N | – | – | N | – | – | – | N | – | – | – | – | – | N | N | – | N | – | – | – |
| Light Chain | CDR3 | 93 | R | K | Q | Q | K | Q | Q | Q | M | K | Q | M | Q | Q | Q | R | Q | R | Q | R | K |
| Light Chain | CDR3 | 94 | A | P | P | P | P | P | P | P | P | A | P | P | A | A | A | A | A | A | P | A | P |
| Light Chain | | 197 | T | T | T | T | T | T | T | T | T | T | T | T | T | T | A | T | T | T | T | T | T |

| | CDR | amino acid number | wild type | URS_2.8a_10.1_1 | URS_2.8a_3.2_1 | URS_2.8a_28.7_1 | URS_2.8a_20.5_1 | URS_2.8a_34.6_1 | URS_2.8a_30.7_1 | URS_2.8a_4.5_1 | URS_2.8a_5.5_1 | URS_2.8b_17.3_1 | URS_2.8b_19.0_1 | URS_2.8a_30.1_1 | URS_2.8a_50.1_1 | URS_2.8a_16.1_1 | URS_2.8b_15.7_1 | URS_2.8a_16.2_1 | URS_2.8a_11.3_1 | URS_2.8b_8.0_1 | URS_2.8b_28.6_1 | URS_2.8b_6.0_2 | URS_2.8a_10.0_1 | URS_2.8a_35.5_1 |
|---|---|---|---|---|---|---|---|---|---|---|---|---|---|---|---|---|---|---|---|---|---|---|---|
| Heavy Chain | CDR1 | 31 | D | H | H | H | H | H | H | H | D | D | D | D | D | D | D | D | D | D | D | D | D | Q |
| Heavy Chain | CDR1 | 32 | V | F | F | F | F | F | F | F | Y | Y | Y | Y | Y | Y | Y | Y | Y | Y | Y | Y | Y | F |
| Heavy Chain | CDR2 | 58 | I | V | V | V | V | V | I | I | V | V | V | V | V | V | V | I | I | I | I | I | I | I |
| Heavy Chain | CDR3 | 100 | S | S | S | S | S | S | K | S | K | K | K | K | S | S | S | K | K | K | K | K | K | S |
| Heavy Chain | CDR3 | 103 | S | S | S | S | S | S | S | S | S | S | S | S | S | S | S | S | S | S | S | Q | Q | S |
| Heavy Chain | CDR3 | 107 | S | S | S | S | Q | S | S | Q | Q | Q | Q | Q | S | Q | Q | S | Q | Q | S | S | S | S |
| Heavy Chain | | 145 | A | A | A | A | A | A | A | A | V | A | A | A | A | A | A | A | A | A | A | A | A | A |
| Heavy Chain | | 220 | E | E | E | E | E | E | E | G | E | E | E | E | E | E | E | E | E | E | E | E | E | E |
| Light Chain | CDR1 | 24 | R | R | R | R | H | H | H | H | H | R | R | H | R | R | H | H | H | R | R | R | H | R |
| Light Chain | CDR1 | 25 | A | T | A | A | T | A | T | T | T | A | A | T | T | T | T | A | T | T | T | T | T | A |
| Light Chain | CDR1 | 26 | S | S | S | S | S | S | S | S | S | S | S | S | S | S | S | S | S | S | S | S | S | S |
| Light Chain | CDR1 | 27 | Q | M | Q | Q | M | Q | M | M | M | Q | Q | M | M | M | M | Q | M | M | M | M | M | Q |
| Light Chain | CDR1 | 28 | G | S | R | R | G | R | R | G | R | R | R | R | R | G | D | R | R | R | R | R | R | R |
| Light Chain | CDR1 | 29 | I | I | V | V | I | V | V | I | V | V | V | V | V | I | I | V | V | V | V | V | V | L |
| Light Chain | | 41 | G | G | G | G | G | G | G | G | G | G | G | G | S | G | G | G | G | G | G | G | G | G |
| Light Chain | CDR2 | 53 | T | T | T | W | T | W | T | T | T | W | W | T | T | T | T | W | T | T | W | W | W | T | S |
| Light Chain | CDR2 | 54 | L | L | L | L | L | F | L | L | L | L | L | L | L | L | L | F | L | L | L | L | L | L | T |
| Light Chain | CDR2 | 55 | Q | K | K | Q | Q | K | Q | Q | K | K | K | Q | Q | K | K | K | K | Q | Q | Q | Q | Q |
| Light Chain | CDR2 | 56 | S | K | S | K | K | K | K | K | K | K | K | K | K | S | K | K | K | K | K | K | K | S |
| Light Chain | CDR3 | 92 | N | D | D | D | D | D | D | D | N | N | D | D | D | D | D | D | D | D | D | D | D | I |
| Light Chain | CDR3 | 93 | R | R | R | R | R | R | R | R | R | R | R | R | R | R | R | R | R | R | R | R | R | Q |
| Light Chain | CDR3 | 94 | A | P | P | P | A | P | P | P | A | P | P | P | P | P | P | P | P | P | P | P | P | P |
| Light Chain | | 144 | A | A | A | A | A | A | A | A | A | A | A | A | A | A | A | A | S | A | A | A | A | A |
| Light Chain | | 212 | G | G | G | G | G | G | G | V | G | G | G | G | G | G | G | G | G | G | G | G | G | G |

Fig.27:

| | CDR | amino acid number | wild type | URS_3.1a_18.4_1 | URS_3.1a_20.0_1 | URS_3.1a_33.0_2 | URS_3.1a_34.7_1 | URS_3.1c_9.8_2 | URS_3.1d_6.1_2 | URS_3.1d_12.7_2 | URS_3.1d_32.0_1 | URS_3.1d_13.8_2 | URS_3.1d_13.5_1 | URS_3.1d_32.0_2 | URS_3.1e_20.1_1 | URS_3.1e_18.7_1 | URS_3.1e_23.5_1 | URS_3.1f_12.1_1 | URS_3.1f_18.3_1 | URS_3.1h_17.4_1 | URS_3.1h_22.0_1 |
|---|---|---|---|---|---|---|---|---|---|---|---|---|---|---|---|---|---|---|---|---|---|
| Heavy Chain | CDR1 | 31 | D | Q | Q | Q | Q | Q | Q | Q | Q | Q | Q | Q | Q | Q | Q | Q | Q | Q | Q |
| Heavy Chain | CDR1 | 32 | Y | F | F | F | F | F | F | F | F | F | F | F | F | F | F | F | F | F | F |
| Heavy Chain | CDR3 | 100 | S | S | K | S | K | K | S | S | S | S | S | S | K | K | K | K | S | S | S |
| Heavy Chain | CDR3 | 103 | S | P | P | P | S | P | S | S | P | S | S | P | P | P | P | S | S | P | P |
| Light Chain | CDR1 | 24 | R | R | R | R | R | R | R | R | R | R | R | R | R | R | T | T | R | R | R |
| Light Chain | CDR1 | 25 | A | A | A | A | A | A | A | A | A | A | A | A | A | A | T | A | A | A | A |
| Light Chain | CDR1 | 27 | Q | Q | Q | Q | Q | Q | Q | Q | Q | Q | Q | Q | M | Q | Q | Q | Q | Q | Q |
| Light Chain | CDR1 | 28 | G | G | G | R | G | G | R | G | R | G | G | R | G | G | G | R | R | G | R |
| Light Chain | CDR1 | 29 | I | I | I | I | I | L | L | L | I | I | I | I | I | L | L | I | L | I | I |
| Light Chain | CDR2 | 53 | T | W | S | W | S | S | S | W | S | W | W | S | S | S | W | S | S | S | W |
| Light Chain | CDR2 | 54 | L | L | T | T | T | T | T | L | T | L | L | T | T | L | L | T | T | T | L |
| Light Chain | CDR2 | 55 | Q | Q | I | Q | I | I | I | Q | I | Q | Q | I | I | I | Q | Q | I | Q | Q |
| Light Chain | CDR2 | 56 | S | S | S | S | R | S | S | S | S | S | S | S | S | R | S | R | S | R | R |
| Light Chain | CDR3 | 92 | N | I | I | N | I | I | I | I | I | I | I | I | D | I | D | I | I | I | I |
| Light Chain | CDR3 | 93 | R | Q | Q | Q | Q | Q | Q | Q | Q | Q | Q | Q | Q | Q | Q | Q | Q | Q | Q |
| Light Chain | CDR3 | 94 | A | P | P | P | P | P | P | P | P | P | P | P | P | P | P | P | P | P | P |
| Light Chain | CDR3 | 95 | P | P | P | P | P | P | P | P | P | P | P | P | P | P | F | P | P | P | P |
| Light Chain | | 104 | V | V | V | V | V | V | V | V | V | V | V | V | V | V | V | I | V | V | V |

Fig.29:

| | CDR | amino acid number | wild type | URS_4.2a_6 | URS_4.1a_49 | URS_4.2a_52 | URS_4.2a_54 | URS_4.2a_14 | URS_4.2a_19 |
|---|---|---|---|---|---|---|---|---|---|
| Heavy Chain | | 13 | Q | Q | H | Q | Q | Q | Q |
| Heavy Chain | | 30 | D | G | G | G | G | D | D |
| Heavy Chain | CDR1 | 31 | D | Q | Q | Q | Q | Q | Q |
| Heavy Chain | CDR1 | 32 | Y | F | F | F | F | F | F |
| Heavy Chain | CDR3 | 100 | S | S | S | K | K | S | K |
| Heavy Chain | CDR3 | 103 | S | S | P | S | S | S | S |
| Light Chain | CDR1 | 24 | R | R | R | T | T | R | T |
| Light Chain | CDR1 | 28 | G | R | R | R | R | R | R |
| Light Chain | CDR1 | 29 | I | L | L | L | L | L | L |
| Light Chain | | 49 | Y | G | R | G | W | W | G |
| Light Chain | CDR2 | 53 | T | S | S | S | S | S | S |
| Light Chain | CDR2 | 54 | L | T | T | T | T | T | T |
| Light Chain | CDR2 | 55 | Q | I | I | Q | Q | I | Q |
| Light Chain | CDR2 | 56 | S | S | S | R | R | S | R |
| Light Chain | CDR3 | 92 | N | I | I | I | I | I | I |
| Light Chain | CDR3 | 93 | R | Q | Q | Q | Q | Q | Q |
| Light Chain | CDR3 | 94 | A | P | P | P | P | P | P |
| Light Chain | | 104 | V | V | V | I | I | V | I |

Fig.31A:

|  | ka | kd | KD (pM) |
|---|---|---|---|
| FabHum | 8,01E+05 | 0,0001405 | 167 |
| 2.1b_9-0_1 | 6,68E+05 | 8,78E-06 | 10 |
| 3.1a_34.7_1 | 7,74E+05 | 1,00E-06 | 1,3 |
| 3.1d_6.1_2 | 7,88E+05 | 1,00E-06 | 1,3 |
| 3.1f_18.3_1 | 5,42E+05 | 2,20E-06 | 3,7 |
| 3.1f_12.1_1 | 9,25E+05 | 1,20E-06 | 1,1 |
| 4.2a_6 | 1,09E+06 | 5,16E-07 | 0,5 |
| 4.2a_26 | 1,06E+06 | 2,57E-06 | 2,6 |
| 4.2a_52 | 1,36E+06 | 6,00E-07 | 0,4 |
| 4.2a_54 | 1,28E+06 | 1,10E-06 | 0,8 |
| 2.4a_13.3_1 | 2,58E+06 | 3,00E-06 | 1,2 |
| 2.4a_21.2_2 | 1,83E+06 | 2,00E-06 | 1,1 |
| 2.8b_6.0_2 | 5,52E+05 | 1,70E-06 | 3,1 |
| 2.8a_10.1_1 | 1,45E+06 | 2,80E-06 | 1,9 |

Fig.33:

SEQ ID NO: 147

EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVSYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 148

DIQMTQSPSSLSASVGDRVTITCRASQGIRNYLAWYQQKPGKAPKLLIYAASWLQSG
VPSRFSGSGSGTDFTLTISSLQPEDVATYYCQRYIQPPYTFGQGTKVEIKRTVAAPSVF
IFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

SEQ ID NO: 149

EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVSYLSTASSLDYW
GQGTLVTVS

SEQ ID NO: 150
DIQMTQSPSSLSASVGDRVTITCRASQGIRNYLAWYQQKPGKAPKLLIYAASWLQSG
VPSRFSGSGSGTDFTLTISSLQPEDVATYYCQRYIQPPYTFGQGTKVEIK

SEQ ID NO: 263
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVKYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 264
DIQMTQSPSSLSASVGDRVTITCRASQGLRNYLAWYQQKPGKAPKLLIYAASSTIRG
VPSRFSGSGSGTDFTLTISSLQPEDVATYYCQRYIQPPYTFGQGTKVEIKRTVAAPSVF
IFPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

SEQ ID NO: 264
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVKYLSTASSLDYW
GQGTLVTVS

SEQ ID NO: 264
DIQMTQSPSSLSASVGDRVTITCRASQGLRNYLAWYQQKPGKAPKLLIYAASSTIRG
VPSRFSGSGSGTDFTLTISSLQPEDVATYYCQRYIQPPYTFGQGTKVEIK

SEQ ID NO: 269
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVSYLsTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 270
DIQMTQSPSSLSASVGDRVTITCRASQRLRNYLAWYQQKPGKAPKLLIYAASSTISGV
PSRFSGSGSGTDFTLTISSLQPEDVATYYCQRYIQPPYTFGQGTKVEIKRTVAAPSVFIF
PPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

SEQ ID NO: 271
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVSYLsTASSLDYW
GQGTLVTVS

SEQ ID NO: 272
DIQMTQSPSSLSASVGDRVTITCRASQRLRNYLAWYQQKPGKAPKLLIYAASSTISGV
PSRFSGSGSGTDFTLTISSLQPEDVATYYCQRYIQPPYTFGQGTKVEIK

SEQ ID NO: 289
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVKYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 290
DIQMTQSPSSLSASVGDRVTITCTASQRLRNYLAWYQQKPGKAPKLLIYAASSTQRG
VPSRFSGSGSGTDFTLTISSLQPEDVATYYCQRYIQPPYTFGQGTKIEIKRTVAAPSVFI
FPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

SEQ ID NO: 291
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVKYLSTASSLDYW
GQGTLVTVS

SEQ ID NO: 292
DIQMTQSPSSLSASVGDRVTITCTASQRLRNYLAWYQQKPGKAPKLLIYAASSTQRG
VPSRFSGSGSGTDFTLTISSLQPEDVATYYCQRYIQPPYTFGQGTKIEIK

SEQ ID NO: 293
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVSYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 294

DIQMTQSPSSLSASVGDRVTITCRASQRLRNYLAWYQQKPGKAPKLLIYAASSTISGV
PSRFSGSGSGTDFTLTISSLQPEDVATYYCQRYIQPPYTFGQGTKVEIKRTVAAPSVFIF
PPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

SEQ ID NO: 295
EVQLVESGGGLVQPGRSLRLSCAASGFTFDQFAMHWVRQAPGKGLEWVSAITWNS
GHIDYADSVEGRFTISRDNAKNSLYLQMNSLRAEDTAVYYCAKVSYLSTASSLDYW
GQGTLVTVS

SEQ ID NO: 296
DIQMTQSPSSLSASVGDRVTITCRASQRLRNYLAWYQQKPGKAPKLLIYAASSTISGV
PSRFSGSGSGTDFTLTISSLQPEDVATYYCQRYIQPPYTFGQGTKVEIK

SEQ ID NO: 301
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVSYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 302
DIQMTQSPSSLSASVGDRVTITCRASQRLRNYLAWYQQKPGKAPKLLIGAASSTISGV
PSRFSGSGSGTDFTLTISSLQPEDVATYYCQRYIQPPYTFGQGTKVEIKRTVAAPSVFIF
PPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

SEQ ID NO: 303
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVSYLSTASSLDYW
GQGTLVTVS

SEQ ID NO: 304
DIQMTQSPSSLSASVGDRVTITCRASQRLRNYLAWYQQKPGKAPKLLIGAASSTISGV
PSRFSGSGSGTDFTLTISSLQPEDVATYYCQRYIQPPYTFGQGTKVEIK

SEQ ID NO: 307
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVKYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 308
DIQMTQSPSSLSASVGDRVTITCTASQRLRNYLAWYQQKPGKAPKLLIGAASSTQRG
VPSRFSGSGSGTDFTLTISSLQPEDVATYYCQRYIQPPYTFGQGTKIEIKRTVAAPSVFI
FPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

SEQ ID NO: 309

EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVKYLSTASSLDYW
GQGTLVTVS

SEQ ID NO: 310
DIQMTQSPSSLSASVGDRVTITCTASQRLRNYLAWYQQKPGKAPKLLIGAASSTQRG
VPSRFSGSGSGTDFTLTISSLQPEDVATYYCQRYIQPPYTFGQGTKIEIK

SEQ ID NO: 311
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVKYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 312
DIQMTQSPSSLSASVGDRVTITCTASQRLRNYLAWYQQKPGKAPKLLIWAASSTQRG
VPSRFSGSGSGTDFTLTISSLQPEDVATYYCQRYIQPPYTFGQGTKIEIKRTVAAPSVFI
FPPSDEQLKSGTASVVCLLNNFYPREAKVQWKVDNALQSGNSQESVTEQDSKDSTY
SLSSTLTLSKADYEKHKVYACEVTHQGLSSPVTKSFNRGEC

SEQ ID NO: 313
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVKYLSTASSLDYW
GQGTLVTVS

SEQ ID NO: 314
DIQMTQSPSSLSASVGDRVTITCTASQRLRNYLAWYQQKPGKAPKLLIWAASSTQRG
VPSRFSGSGSGTDFTLTISSLQPEDVATYYCQRYIQPPYTFGQGTKIEIK

SEQ ID NO: 319
EVQLVESGGGLVQPGRSLRLSCAASGFTFDHFAMHWVRQAPGKGLEWVSAITWNS
GHVDYADSVEGRFTISRDNAKNSLYLQMNSLRAEDTAVYYCAKVSYLSTASSLDY
WGQGTLVTVSSASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSC

SEQ ID NO: 320
DIQMTQSPSSLSASVGDRVTITCRTSMSIRNYLAWYQQKPGKAPKLLIYAASTLKKG
VPSRFSGSGSGTDFTLTISSLQPEDVATYYCQRYDRPPYTFGQGTKVEIKRTVAAPSV
FIFPPSDEQLKSGTASVVCLLNNFYPREAKVQWKVDNALQSGNSQESVTEQDSKDST
YSLSSTLTLSKADYEKHKVYACEVTHQGLSSPVTKSFNRGEC

SEQ ID NO: 321
EVQLVESGGGLVQPGRSLRLSCAASGFTFDHFAMHWVRQAPGKGLEWVSAITWNS
GHVDYADSVEGRFTISRDNAKNSLYLQMNSLRAEDTAVYYCAKVSYLSTASSLDY
WGQGTLVTVS

SEQ ID NO: 322
DIQMTQSPSSLSASVGDRVTITCRTSMSIRNYLAWYQQKPGKAPKLLIYAASTLKKG
VPSRFSGSGSGTDFTLTISSLQPEDVATYYCQRYDRPPYTFGQGTKVEIK

SEQ ID NO: 357
EVQLVESGGGLVQPGRSLRLSCAASGFTFDDYAMHWVRQAPGKGLEWVSAITWNS
GHIDYADSVEGRFTISRDNAKNSLYLQMNSLRAEDTAVYYCAKVKYLSTASQLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 358
DIQMTQSPSSLSASVGDRVTITCRTSMRVRNYLAWYQQKPGKAPKLLIYAASWLQK
GVPSRFSGSGSGTDFTLTISSLQPEDVATYYCQRYDRPPYTFGQGTKVEIKRTVAAPS
VFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

SEQ ID NO: 359
EVQLVESGGGLVQPGRSLRLSCAASGFTFDDYAMHWVRQAPGKGLEWVSAITWNS
GHIDYADSVEGRFTISRDNAKNSLYLQMNSLRAEDTAVYYCAKVKYLSTASQLDYW
GQGTLVTVS

SEQ ID NO: 360
DIQMTQSPSSLSASVGDRVTITCRTSMRVRNYLAWYQQKPGKAPKLLIYAASWLQK
GVPSRFSGSGSGTDFTLTISSLQPEDVATYYCQRYDRPPYTFGQGTKVEIK

SEQ ID NO: 373
EVQLVESGGGLVQPGRSLRLSCAASGFTFGDYAMHWVRQAPGKGLEWVSAITWNS
GHVDYADSVEGRFTISRDNAKNSLYLQMNSLRAEDTAVYYCAKVSYLSTASSLDY
WGQGTLVTVSSASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSC

SEQ ID NO: 374
DIQMTQSPSSLSASVGDRVTITCHTSMRVRNYLAWYQQKPGKAPKLLIRAASTLKSG
VPSRFSGSGSGTDFTLTISSLQPEDVATYYCQRYDRAPYTFGQGTKVEIKRTVAAPSV
FIFPPSDEQLKSGTASVVCLLNNFYPREAKVQWKVDNALQSGNSQESVTEQDSKDST
YSLSSTLTLSKADYEKHKVYACEVTHQGLSSPVTKSFNRGEC

SEQ ID NO: 375
EVQLVESGGGLVQPGRSLRLSCAASGFTFGDYAMHWVRQAPGKGLEWVSAITWNS
GHVDYADSVEGRFTISRDNAKNSLYLQMNSLRAEDTAVYYCAKVSYLSTASSLDY
WGQGTLVTVS

SEQ ID NO: 376
DIQMTQSPSSLSASVGDRVTITCHTSMRVRNYLAWYQQKPGKAPKLLIRAASTLKSG
VPSRFSGSGSGTDFTLTISSLQPEDVATYYCQRYDRAPYTFGQGTKVEIK

SEQ ID NO: 399
EVQLVESGGGLVQPGRSLRLSCAASGFTFGDYAMHWVRQAPGKGLEWVSAITWNS
GHIDYADSVEGRFTISRDNAKNSLYLQMNSLRAEDTAVYYCAKVKYLSTASQLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 400

DIQMTQSPSSLSASVGDRVTITCRTSMRVRNYLAWYQQKPGKAPKLLIYAASWLQS
GVPSRFSGSGSGTDFTLTISSLQPEDVATYYCQRYDRPPYTFGQGTKVEIKRTVAAPS
VFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

SEQ ID NO: 401
EVQLVESGGGLVQPGRSLRLSCAASGFTFGDYAMHWVRQAPGKGLEWVSAITWNS
GHIDYADSVEGRFTISRDNAKNSLYLQMNSLRAEDTAVYYCAKVKYLSTASQLDYW
GQGTLVTVS

SEQ ID NO: 402
DIQMTQSPSSLSASVGDRVTITCRTSMRVRNYLAWYQQKPGKAPKLLIYAASWLQS
GVPSRFSGSGSGTDFTLTISSLQPEDVATYYCQRYDRPPYTFGQGTKVEIK

SEQ ID NO: 451
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVSYLSTASSLDYW
GQGTLVTVSSASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSC

SEQ ID NO: 452
DIQMTQSPSSLSASVGDRVTITCRASQRLRNYLAWYQQKPGKAPKLLIGAASSTISGV
PSRFSGSGSGTDFTLTISSLQPEDVATYYCQRYIQPPYTFGQGTKVEIKRTVAAPSVFIF
PPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

SEQ ID NO: 453
EVQLVESGGGLVQPGRSLRLSCAASGFTFGQFAMHWVRQAPGKGLEWVSAITWNS
GHIDYADSVEGRFTISRDNAKNSLYLQMNSLRAEDTAVYYCAKVSYLSTASSLDYW
GQGTLVTVS

SEQ ID NO: 454
DIQMTQSPSSLSASVGDRVTITCRASQRLRNYLAWYQQKPGKAPKLLIGAASSTISGV
PSRFSGSGSGTDFTLTISSLQPEDVATYYCQRYIQPPYTFGQGTKVEIK

Fig.34:

SEQ ID NO: 457
MEFGLRWVFLVAILKDVQCEVQLVESGGGLVQPGRSLRLSCAASGFTFDQFAMHW
VRQAPGKGLEWVSAITWNSGHIDYADSVEGRFTISRDNAKNSLYLQMNSLRAEDTA
VYYCAKVSYLSTASSLDYWGQGTLVTVSSASTKGPSVFPLAPSSKSTSGGTAALGCL
VKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLN
GKEYKCKVSNKALPAPIEKTISKAKGQPREPQVYTLPPSRDELTKNQVSLTCLVKGF
YPSDIAVEWESNGQPENNYKTTPPVLDSDGSFFLYSKLTVDKSRWQQGNVFSCSVM
HEALHNHYTQKSLSLSPGK

SEQ ID NO: 458
MDMRVPAQLLGLLLLWFPGARCDIQMTQSPSSLSASVGDRVTITCRASQGIRNYLA
WYQQKPGKAPKLLIYAASWLQSGVPSRFSGSGSGTDFTLTISSLQPEDVATYYCQRYI
QPPYTFGQGTKVEIKRTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVT
KSFNRGEC

SEQ ID NO: 459
MEFGLRWVFLVAILKDVQCEVQLVESGGGLVQPGRSLRLSCAASGFTFDGFAMHW
VRQAPGKGLEWVSAITWNSGHIDYADSVEGRFTISRDNAKNSLYLQMNSLRAEDTA
VYYCAKVSYLSTASSLDYWGQGTLVTVSSASTKGPSVFPLAPSSKSTSGGTAALGCL
VKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLN
GKEYKCKVSNKALPAPIEKTISKAKGQPREPQVYTLPPSRDELTKNQVSLTCLVKGF
YPSDIAVEWESNGQPENNYKTTPPVLDSDGSFFLYSKLTVDKSRWQQGNVFSCSVM
HEALHNHYTQKSLSLSPGK

SEQ ID NO: 460
MDMRVPAQLLGLLLLWFPGARCDIQMTQSPSSLSASVGDRVTITCRASQGIRNYLA
WYQQKPGKAPKLLISAAGWLQSGVPSRFSGSGSGTDFTLTISSLQPEDVATYYCQRY
NQAPYTFGQGTKVEIKRTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPV
TKSFNRGEC

SEQ ID NO: 461
MEFGLRWVFLVAILKDVQCEVQLVESGGGLVQPGRSLRLSCAASGFTFDDYAMHW
VRQAPGKGLEWVSAITWNSGHIDYADSVEGRFTISRDNAKNSLYLQMNSLRAEDTA
VYYCAKVSYLSTASSLDYWGQGTLVTVSSASTKGPSVFPLAPSSKSTSGGTAALGCL
VKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTC
VVVDVSHEDPEVKFNWYVDGVEVHNAKTKPREEQYNSTYRVVSVLTVLHQDWLN
GKEYKCKVSNKALPAPIEKTISKAKGQPREPQVYTLPPSRDELTKNQVSLTCLVKGF
YPSDIAVEWESNGQPENNYKTTPPVLDSDGSFFLYSKLTVDKSRWQQGNVFSCSVM
HEALHNHYTQKSLSLSPGK

SEQ ID NO: 462
MDMRVPAQLLGLLLLWFPGARCDIQMTQSPSSLSASVGDRVTITCRASQGIRNYLA
WYQQKPGKAPKLLIYAASTLQSGVPSRFSGSGSGTDFTLTISSLQPEDVATYYCQRY
NRAPYTFGQGTKVEIKRTVAAPSVFIFPPSDEQLKSGTASVVCLLNNFYPREAKVQW
KVDNALQSGNSQESVTEQDSKDSTYSLSSTLTLSKADYEKHKVYACEVTHQGLSSPV
TKSFNRGEC

ANTIBODIES TO TNFα

This application is a national phase of PCT/EP2008/011120 filed on Dec. 24, 2008, which claims the benefit of Ser. No. 61/018,436 filed on Dec. 31, 2007.

This application incorporates by reference the contents of a 934 kb text file created on Jun. 16, 2010 and named "sequencelisting.txt," which is the sequence listing for this application.

FIELD OF THE INVENTION

The technology provided herein relates to antibodies, antigen binding portions, and derivatives thereof, nucleic acids encoding the antibodies, antigen binding portions, or derivatives thereof, as well as complementary nucleic acids, vectors and host cells containing the nucleic acids.

BACKGROUND

TNFα is a cytokine produced by white blood cells, including monocytes and macrophages. The cytokine stimulates and activates the immune system in response to conditions such as infection or cancer. TNFα is thought to be involved in a variety of human diseases and disorders, including sepsis, infections, autoimmune diseases, transplant rejection and graft-versus-host disease. Furthermore, over production of TNFα can lead to immunological disorders, such as rheumatoid arthritis or psoriasis.

In light of the role that TNFα plays in a human disease, antibodies that bind to TNFα have been sought for use in therapy to inhibit TNFα activity. (See, for example U.S. Pat. No. 6,090,382 to Salfeld, et al., WO2006/014477 to Crea, et al., and Rajpal, et al., PNAS 102:8466-8471). Therefore, it is important to develop human antibodies, antigen binding portions, and derivatives thereof that are capable of binding TNFα with high affinity and/or slow dissociation kinetics.

SUMMARY OF THE INVENTION

Provided herein are antibodies, antigen binding portions, or derivatives thereof that are capable of binding TNFα. In some embodiments, the antibodies or antigen binding portions thereof have improved properties such as affinity to TNFα compared to a base antibody or antigen binding portion thereof comprising the heavy and light chains of SEQ ID NOs. 1 and 2, respectively or the variable regions thereof. The heavy and light chain sequences for the antibodies and antigen binding portions and derivatives provided herein are described in terms of a base sequence having one or more alterations compared to that sequence. Alterations in the amino acid sequence are specified by providing the residue number preceded by the wild type amino acid and followed by the variant amino acid present at that position. For example, for the heavy chain having a glycine at position or residue 31 of SEQ ID NO. 1 instead of the wild type aspartate is specified as "D31G" using the one letter designation code for amino acids.

Antibodies, antigen binding portions, or derivatives thereof capable of binding TNF-α are provided. In some embodiments, the antibodies, antigen binding portions, or derivatives thereof comprise a heavy chain or variable region thereof comprising an amino acid sequence of SEQ ID NO. 1 having at least one alteration selected from the group consisting of Q3R, D31G, D31N, D31T, D31R, Y32F, Y32Q, M34I, A40V, A50G, I58T, I58V, E65R, G66N, and S103P.

In some embodiments, the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G.

In some embodiments, the antibody, antigen binding portion or derivative thereof comprises a heavy chain comprising an amino acid sequence of SEQ ID NO. 1 having at least one alteration in the sequence selected from the group consisting of Q3R, D31G, D31N, D31T, D31R, Y32F, Y32Q, M34I, A40V, A50G, I58T, I58V, E65R, G66N, and S103P and a light chain comprising an amino acid sequence of SEQ ID NO. 2 having at least one alteration in the sequence selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, V196A T180I, and C214G.

In some embodiments, the antibody or antigen binding portion thereof capable of binding TNF-α wherein the antibody or antigen binding portion thereof comprises a heavy chain CDR1 region comprising amino acids 31-35 of SEQ ID NO. 1, a heavy chain CDR2 region comprising amino acids 50-66 of SEQ ID NO. 1 and a heavy chain CDR3 region comprising amino acids 99-100 of SEQ ID NO. 1 and having at least one alteration selected from the group consisting of D31G, D31N, D31T, D31R, Y32F, Y32Q, M34I, A50G, I58T, I58V, E65R, G66N, and S103P and wherein the antibody or antigen binding portion thereof further optionally comprises a light chain CDR1 region comprising amino acids 24-34 of SEQ ID NO. 2, a light chain CDR2 region comprising amino acids 50-56 of SEQ ID NO. 2 and a light chain CDR3 region comprising amino acids 89-97 of SEQ ID NO. 2 having at least one alteration selected from the group consisting of R24L, R24A, R24T, R25S, R25G, R25T, S26T, Q27M, Q27V, Q27W, G28S, G28P, G28R, G28L, I29V, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, and P95V.

Nucleic acid sequences encoding the heavy and light chains of the antibodies, antigen binding portions, or derivatives thereof are also provided herein. The base heavy chain amino acid sequence encoded by the nucleic acid sequence is provided in SEQ ID NO. 1. A sample nucleic acid sequence encoding the base heavy chain amino acid sequence is provided in SEQ ID NO. 3. The base light chain amino acid sequence encoded by the nucleic acid sequence is provided in SEQ ID NO. 2. A sample nucleic acid sequence encoding the base light chain amino acid sequence is provided in SEQ ID NO. 4.

The antibodies, antigen binding portions, or derivatives thereof can be used for preparing compositions to be administered to a patient for the treatment of diseases such as rheumatoid arthritis, inflammatory bowel disease, psoriasis, and Crohn's disease as well as other diseases connected with TNFα. The antibodies, antigen binding portions, or derivatives thereof can also be used in assays, such as diagnostic assays, to detect TNFα or measure the level of TNFα in a biological sample.

BRIEF DESCRIPTION OF THE DRAWINGS

FIG. 1 shows the amino acid sequences of the heavy (SEQ ID NO. 1) and light (SEQ ID NO. 2) chains of the base Fab; CDRs 1, 2, and 3 of both the heavy and light chain are underlined as indicated.

FIG. 2 is a Table showing Fab variants provided herein having heavy chains with the indicated alterations in CDR-1 together with wild type light chains or light chains with the indicated alterations compared to the corresponding base Fab sequence (wild type).

FIG. 4 is a Table showing heavy chain variants provided herein the indicated altered residues in CDR-2 compared to the corresponding base heavy chain sequence (wild type).

FIG. 5A-5B are charts showing data from a homogenous time-resolved energy transfer assay using Fab comprising the indicated variants from FIG. 4 compared to FabHUM.

FIG. 6 is a Table showing heavy chain variants provided herein having the indicated altered residues in CDR-3 compared to the corresponding base heavy chain sequence (wild type).

FIG. 8 is a Table showing light chain variants provided herein having the indicated altered residues in CDR-1 compared to the corresponding base light chain sequence (wild type).

FIG. 9A-9G are charts showing data from a homogenous time-resolved energy transfer assay using Fab comprising the indicated variants from FIG. 8 compared to FabHUM.

FIG. 10 is a Table showing light chain variants provided herein having the indicated altered residues in CDR-2 and other altered residues together with wild type heavy chain or heavy chain with the indicated alterations compared to the corresponding base sequence (wild type).

FIG. 11A-11I are charts showing data from a homogenous time-resolved energy transfer assay using Fab comprising the indicated variants from FIG. 10 compared to FabHUM.

FIG. 14 is a Table showing variants provided herein having heavy and light chains with the indicated altered residues compared to the corresponding base sequences (wild type).

FIG. 16 shows sample nucleic acid sequences (SEQ ID NO. 3 and SEQ ID NO. 4) encoding SEQ ID NOs. 1 and 2, respectively.

FIG. 17 is a Table showing variants provided herein having heavy and light chains with the indicated altered residues compared to the corresponding base sequences (wild type).

FIG. 21 is a Table showing variants provided herein having heavy and light chains with the indicated altered residues compared to the corresponding base sequences (wild type).

Figure 23:
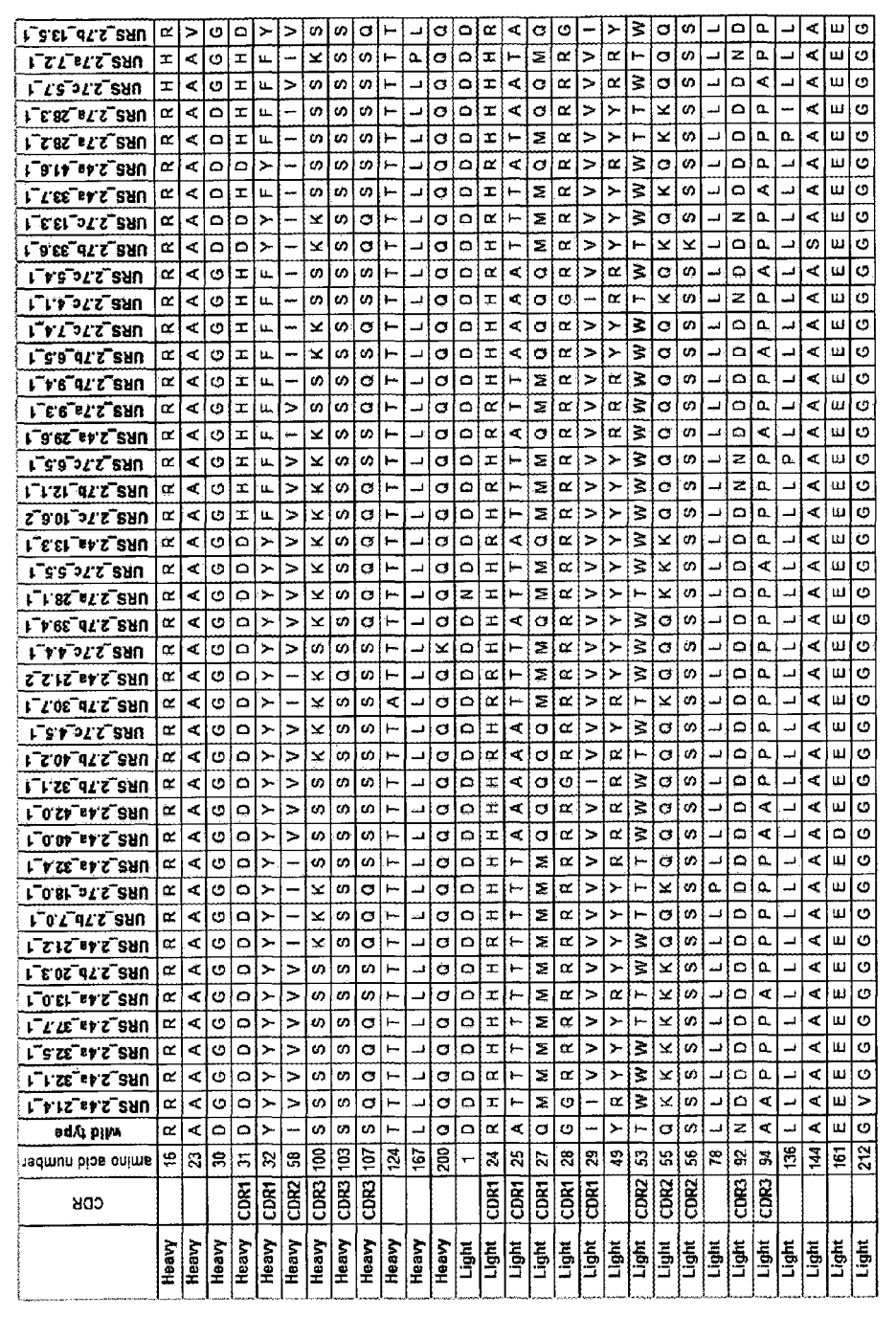

FIG. 23 is a Table showing variants provided herein having heavy and light chains with the indicated altered residues compared to the corresponding base sequences (wild type).

FIG. 25 is a Table showing variants provided herein having heavy and light chains with the indicated altered residues compared to the corresponding base sequences (wild type).

FIG. 27 is a Table showing variants provided herein having heavy and light chains with the indicated altered residues compared to the corresponding base sequences (wild type).

FIG. 29 is a Table showing variants provided herein having heavy and light chains with the indicated altered residues compared to the corresponding base sequences (wild type).

FIG. 33 shows the sequence of several variants of the invention.

FIG. 34 shows the full length antibody sequence of several variants of the invention (URS_2.1b_9.0_1—Heavy chain, URS_2.1b_9.0_1—Light chain, URS_2.1_H2_3_72—Heavy chain, URS_2.1_H2_3_72—Light chain, HUMIRA—Heavy chain, HUMIRA—Light chain; SEQ ID NO: 457-462, respectively).

DETAILED DESCRIPTION OF THE INVENTION

Figure 3A:
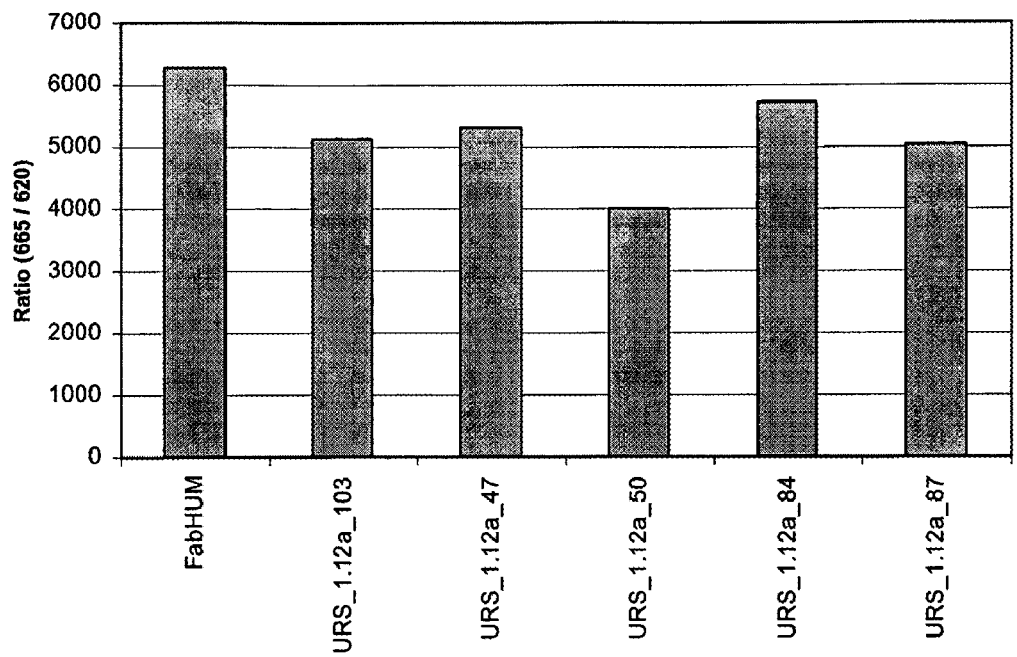
FIG. 3A-3C are charts showing data from a homogenous time-resolved energy transfer assay using the indicated Fab variants from FIG. 2 compared to FabHUM.

Disclosed herein are antibodies, antigen binding portions, and derivatives thereof (also referred to herein as "antibody" or "antibodies") that are capable of binding to TNFα. The antibodies comprise one or more alterations in the amino acid sequence of the heavy and/or light chain variable regions of SEQ ID NOs. 1 and 2, respectively. It is well known to one of ordinary skill in the art that the regions of both the light chain and the heavy chain of an immunoglobulin contain antigen binding sites. The regions containing the antigen binding sites are composed of four relatively invariant "framework regions" (FRs) and three highly variant "hypervariable regions" (HVs). Because the HVs constitute the binding site for antigen(s) and determine specificity by forming a surface complementarity to the antigen, they are called the "complementarity-determining regions", or CDRs, and are denoted CDR1, CDR2, and CDR3, and numbering begins with CDR1 at the N-terminus of the heavy or light chain, respectively.

In some embodiments, the antibodies comprise unique CDR1 regions within the variable region of the heavy chain. The antibody or antigen binding portion or derivative thereof can comprise a heavy chain variable region comprising SEQ ID NO. 1 having at least one alteration selected from the group consisting of D31 G, D31 T, D31N, D31R, Y32F, Y32Q, and A40V, and further optionally comprising a light chain variable region comprising an amino acid sequence of SEQ ID NO. 2 having at least one alteration selected from the group consisting of T129A, Q166R, and T180I. For example, the antibody or antigen binding portion or derivative thereof can comprise SEQ ID NO. 1 or residues 30-35 of SEQ ID NO. 1, wherein residue 31 is H and residue 32 is F; or wherein residue 31 is G and residue 32 is F or Q; or wherein residue 31 is N; or wherein residue 32 is S; or wherein residue 31 is T and residue 32 is F; or wherein residue 3 is G and residue 32 of SEQ ID NO. 1 is F; or wherein residue 31 of SEQ ID NO. 1 is R. In other embodiments, residue 31 is Q and further optionally comprising a light chain having SEQ ID NO. 2 wherein residue 180 of SEQ ID NO. 2 is I; or wherein residue 32 of SEQ ID NO. 1 is S or F and optionally comprising a light chain having SEQ ID NO. 2 wherein residue 166 of SEQ ID NO. 2 is R; or wherein residue 31 of SEQ ID NO. 1 is H and further optionally comprising a light chain having a sequence of SEQ ID NO. 2, wherein residue 40 of SEQ ID NO. 2 is V and residue 129 of SEQ ID NO. 2 is A.

In other embodiments, the antibodies comprise unique CDR2 region within the variable region of the heavy chain. For example, the antibody or antigen binding portion or derivative thereof can comprise SEQ ID NO. 1 or residues 50-66 of SEQ ID NO. 1, wherein residue 50 is G; or wherein residue 58 is T or V.

In other embodiments, the antibodies comprise unique CDR3 region within the variable region of the heavy chain. For example, the antibody or antigen binding portion or derivative thereof can comprise SEQ ID NO. 1 or residues 99-110 of SEQ ID NO. 1, wherein residue 103 is P.

In addition, the heavy chain variable region of the antibody, antigen binding portion, or derivative thereof can further comprise at least one alteration of SEQ ID NO. 1 selected from the group consisting of D31H, D31Q, Y32S, and S100K.

In some embodiments, the antibodies comprise unique CDR1 region within the variable region of the light chain. The antibody or antigen binding portion or derivative thereof of can comprise a light chain variable region comprising SEQ ID NO. 2 or amino acids 23-34 of SEQ ID NO. 2 and having at least one alteration selected from the group consisting of R24L, R24A, R24T, R25S, R25G, R25T, S26T, Q27M, Q27V, Q27W, G28S, G28P, G28R, G28L, and I29V. For example, the antibody or antigen binding portion or derivative thereof can comprise SEQ ID NO. 2 or residues 23-34 of SEQ ID NO. 2, wherein residue 24 is L and residue 25 of SEQ ID NO. 2 is S or G, and optionally wherein residue 29 of SEQ ID NO. 2 is L; or wherein residue 24 is A or T; or wherein residue 25 is S or T and optionally wherein residue 27 is M; or wherein residue 27 is Y, V, or W and optionally wherein residue 26 is T; or wherein residue 28 is S, P, R, or L and optionally wherein residue 29 is L or V.

In some embodiments, the antibodies comprise unique CDR2 region within the variable region of the light chain. The antibody or antigen binding portion or derivative thereof of can comprise a light chain variable region comprising SEQ ID NO. 2 or amino acids 50-56 of SEQ ID NO. 2 and having at least one alteration selected from the group consisting of S52N, S52G, S52W, T53W, T53Y, T53G, T53F, T53V, L54S, L54T, Q55I, Q55K, S56R, G57S, and C214G and further optionally comprising a heavy chain comprising an amino acid sequence of SEQ ID NO. 1 and having at least one alteration selected from the group consisting of E65R and G66N. For example, the antibody or antigen binding portion or derivative thereof can comprise SEQ ID NO. 2 or amino acids 50-56 of SEQ ID NO. 2 wherein residue 53 is W; or wherein residue 52 is W, G, or N; or wherein residue 53 is Y, F, or V and optionally wherein residue 52 is N or optionally wherein residue 57 is S; or wherein residue 53 is S and residue 214 is G and further optionally comprising a heavy chain having an amino acid sequence of SEQ ID NO. 1 wherein residue 65 is R and residue 66 is N; or wherein residue 54 of SEQ ID NO. 2 is S or T and optionally wherein residue 55 is I, K, or L; or wherein residue 56 is R.

In some embodiments, the antibodies comprise unique CDR3 region within the variable region of the light chain. The antibody or antigen binding portion or derivative thereof of can comprise a light chain variable region comprising SEQ ID NO. 2 or amino acids 89-97 of SEQ ID NO. 2 and having at least one alteration selected from the group consisting of V15M, N92I, R93Q, R93M, A94S, P95Q, P95A, P95S, P95M, P95E, and P95V. For example, the antibody or antigen binding portion or derivative thereof can comprise SEQ ID NO. 2 or amino acids 89-97 of SEQ ID NO. 2 wherein residue 94 is P and residue 95 is M and optionally wherein residue 15 is M; or wherein residue 92 is I and optionally wherein residue 93 is Q and residue 94 is P; or wherein residue 92 of is D and residue 93 is M; or wherein residue 93 of SEQ ID NO. 2 is M and optionally wherein residue 94 is P; or wherein residue 93 is Q and optionally wherein residue 94 is P; or wherein residue 93 is K and residue 94 is S; or wherein residue 94 is P and residue 95 is selected from the group consisting of Q, A, S, M, E, and V.

In addition, the light chain variable region of the antibody, antigen binding portion, or derivative thereof can further comprise at least one alteration of SEQ ID NO. 2 selected from the group consisting of Q27L, Q27Y, Q27K, 129L, T53S, Q55L, N92D, R93K and A94P.

The various embodiments described herein can be complimentary and can be combined or used together in a manner understood by the skilled person in view of the teachings contained herein. Thus, the antibodies, antigen binding portions, and derivatives thereof provided herein also include combinations of the above described variations. For example, the antibody or antigen binding portion or derivative thereof can comprise SEQ ID NO. 2 having at least one alteration in the sequence selected from the group consisting of S52N, S52G, S52W, T53W, V58M, N92I, R93K, R93Q and A94P and optionally comprising a heavy chain having a sequence of SEQ ID NO. 2 and having at least one alteration selected from the group consisting of D31H, D31Q, Y32F, and Y32S.

In some embodiments, the antibodies, antigen binding portions, or derivatives thereof have improved affinity for TNFα compared to an antibody, antigen binding portion, or derivative thereof comprising the variable regions of the heavy and light chains of SEQ ID NOs. 1 and 2, respectively. Improved affinity can be a function of an improved dissociation constant $K_D$ or an improved $k_{off}$ rate constant. In some embodiments the improved $K_D$ dissociation constant or improved $k_{off}$ rate constant is at least 1.5 fold lower, or 2, 3, or 4 fold lower than that of an antibody or antigen binding fragment thereof that comprises the variable region of a heavy chain having the amino acid sequence of SEQ ID NO. 1 and the variable region of a light chain having the amino acid sequence of SEQ ID NO. 2.

In a preferred embodiment the improved $K_D$ dissociation constant or improved $k_{off}$ rate constant is at least 10 fold lower, or 15, 20, 30 fold lower than that of an antibody or antigen binding fragment thereof that comprises the variable region of a heavy chain having the amino acid sequence of SEQ ID NO. 1 and the variable region of a light chain having the amino acid sequence of SEQ ID NO. 2.

In some embodiments, the antibody, antigen binding portion, or derivative thereof or nucleic acid encoding same is isolated. An isolated biological component (such as a nucleic acid molecule or protein such as an antibody) is one that has been substantially separated or purified away from other biological components in the cell of the organism in which the component naturally occurs, e.g., other chromosomal and extra-chromosomal DNA and RNA, proteins and organelles. Nucleic acids and proteins that have been "isolated" include nucleic acids and proteins purified by standard purification methods. The term also embraces nucleic acids and proteins prepared by recombinant expression in a host cell as well as chemically synthesized nucleic acids.

Amino acids are referred to herein using the name of the amino acid, the three letter abbreviation or the single letter abbreviation. The table below provides a list of the standard amino acids together with their abbreviations.

| | | |
|---|---|---|
| Alanine | A | Ala |
| Cysteine | C | Cys |
| Aspartic acid | D | Asp |
| Glutamic acid | E | Glu |
| Phenylalanine | F | Phe |
| Glycine | G | Gly |
| Histidine | H | His |
| Isoleucine | I | Ile |
| Lysine | K | Lys |
| Leucine | L | Leu |
| Methionine | M | Met |
| Asparagine | N | Asn |
| Proline | P | Pro |
| Glutamine | Q | Gln |
| Arginine | R | Arg |
| Serine | S | Ser |
| Threonine | T | Thr |
| Valine | V | Val |
| Tryptophan | W | Trp |
| Tyrosine | Y | Tyr |
| Cysteine | C | Cys |
| Aspartic acid | D | Asp |

In addition to the specific amino acid variations and nucleic acids encoding the variations, conservative amino acid substitutions of the variations are provided herein. Such substitutions are those which are conservative, for example, wherein the variant amino acid is replaced by another amino acid of the same general type. Amino acids can be classified as acidic, basic, neutral and polar, or neutral and nonpolar and/or aromatic, depending on their side chain. Preferred substitutions of a variant amino acid position include those that have one or more classifications that are the same as the variant amino acid at that position. Thus, in general, amino acids Lys, Arg, and H is are basic; amino acids aspartic and glutamic are acidic; amino acids Ser, Thr, Cys, Gln, and Asn are neutral polar; amino acids Gly, Ala, Val, Ile, and Leu are nonpolar aliphatic, and amino acids Phe, Trp, and Tyr are aromatic. Gly and Ala are small amino acids and Val, Ile and Leu are alipathic amino acids.

As described herein, antigen binding fragments and derivatives thereof of an antibody includes any portion of an antibody that specifically binds to the antigen. For example, an antigen-binding fragment of an antibody includes molecules in which one or more immunoglobulin chain is not full length but which is capable of specifically binding to the antigen. Examples of binding fragments encompassed within the term "antigen binding fragment thereof" include, for example, (i) a Fab fragment, e.g., a monovalent fragment consisting of the VL, VH, CL and CH1 domains; (ii) a F(ab')$_2$ fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a dAb fragment (Ward et al., (1989) Nature 341:544-546), which consists of a VH domain; and (vi) an isolated complementarity determining region (CDR) having sufficient framework capable of specifically binding to the antigen, e.g., an antigen binding portion of a variable region. An antigen binding portion of a light chain variable region and an antigen binding portion of a heavy chain variable region, e.g., the two domains of the Fv fragment, VL and VH, can be joined, using recombinant methods, by a synthetic linker that enables them to be made as a single protein chain in which the VL and VH regions pair to form monovalent molecules (known as single chain Fv (scFv); see e.g., Bird et al. (1988) Science 242:423-426; and Huston et al. (1988) Proc. Natl. Acad. Sci. USA 85:5879-5883). Such single chain antibodies are also intended to be encompassed within the term "antigen-binding fragment thereof". These antibody fragments are generated using conventional techniques known to those of ordinary skill in the art, and the fragments are screened for binding ability in the same manner as are intact antibodies. The aforementioned antibody, antigen binding portion, or derivative thereof also encompass recombinant binding proteins which comprise in addition to the aforementioned TNF-alpha binding domain one or more additional domains with binding affinities to other proteins and/or epitops, such as Diabodies, Bis-scFvs, bispecific Fab$_2$ or trispecific Fab$_3$ (see, P. Holliger and P. J. Hudson, Nature Biotechnology, 2005, Vol. 23, Number 9, page 1126-1136). These binding proteins are generated using conventional techniques known to those of ordinary skill in the art, and the fragments are screened for binding ability in the same manner as are intact antibodies. In addition, the antibody, antigen binding portion, or derivative thereof is a human antibody e.g. can be of human origin or being humanized. While human antibodies or fragments or derivatives thereof are preferred, other antibodies which can be employed in the molecules of the invention are murine, chimeric and humanized antibodies. These chimeric or humanized antibodies and antibody fragments are generated using conventional techniques known to those of ordinary skill in the art. Human monoclonal antibodies or fragments and derivatives thereof are preferred.

In addition, the antibody, antigen binding portion, or derivative thereof can be derivatized, for example to improve its biochemical stability or to conjugate it to a detectable label or therapeutic agent. For example, the antibody, antigen binding portion, or derivative thereof can be conjugated to a polymeric backbone, such as polyethylene glycol ("PEG"), cellulose, dextran, agarose, or an amino acid copolymer. Other examples of derivatization include labeling with radioactive isotopes, fluorophores, chemiluminescent agents, cell toxic agents and enzymes. These modifications can readily be made by one of ordinary skill in the art such that the ability of the antibodies or antigen binding portions or derivatives thereof to bind TNFα remains intact.

It is well known to one of ordinary skill in the art that the genetic code is degenerate, that is more than one codon triplet can code for the same amino acid. Therefore, the nucleic acids provided herein also include alternate sequence that use different codons to encode the same amino acid sequence. Furthermore, the nucleic acids provided herein also include both the coding sequence and the complementary sequence of nucleic acids encoding the antibodies, antigen binding fragments thereof and derivatives thereof provided herein.

The altered heavy and light chains or variable regions thereof provided herein can be generated by standard methods in the art. For example, to generate the altered heavy chain, one of ordinary skill in the art can mutagenize the base nucleic acid sequence such that the resulting mutagenized sequence encodes the altered heavy chain. In one embodiment, the base sequence for the heavy chain is provided in SEQ ID NO. 3. Similarly, to generate the altered light chain, one or ordinary skill in the art can mutagenize SEQ ID NO. 4 such that the resulting mutagenized sequence encodes the altered light chain. As described herein, it is understood that because of the degeneracy of the genetic code, the base nucleic sequence can be different from that shown in SEQ ID NO. 3 or 4 and still encode the amino acid sequences of SEQ ID NO. 1 or 2, respectively.

One of ordinary skill in the art can readily mutagenize a sequence that encodes the desired heavy or light chain even where the nucleic acid sequence uses different codons to encode the amino acid sequence. The nucleic acid to be used in the mutagenesis can be made, for example, using chemical synthesis methods that are known in the art, or for example by PCR assembly of oligonucleotides or ligation of oligonucleotides to generate the base sequence. The alterations in the nucleic acid sequence can be made using oligonucleotides designed to incorporate specific changes at predetermined positions within the encoding nucleic acids (e.g., by oligonucleotide mutagenesis). Mutagenesis methods as described by Kunkle et al., Proc. Natl. Acad. Sci. U.S.A., 82:488-492 (1985) are suitable methods. Other suitable methods known in the art such include PCR mutagenesis. Site-directed mutagenesis (Carter et al., Nucl. Acids Res., 13:4331 (1986); Zoller et al., Nucl. Acids Res., 10:6487 (1987)), cassette mutagenesis Wells et al., Gene, 34:315 (1985), restriction selection mutagenesis (Wells et al., Philos. Trans. R. Soc. London SerA, 317:415 (1986)). Polynucleotides encoding the altered heavy or light chains can also be made, for example, by direct synthesis of the nucleic acid sequence encoding the altered amino acid sequence.

An antibody, antigen binding portion, or derivative thereof provided herein can be prepared by recombinant expression of nucleic acid sequences encoding light and heavy chains or portions thereof in a host cell. To express an antibody, antigen binding portion, or derivative thereof recombinantly, a host cell can be transfected with one or more recombinant expression vectors carrying DNA fragments encoding the light and/or heavy chains or portions thereof such that the light and heavy chains are expressed in the host cell. Standard recombinant DNA methodologies are used prepare and/or obtain nucleic acids encoding the heavy and light chains, incorporate these nucleic acids into recombinant expression vectors and introduce the vectors into host cells, such as those described in Sambrook, Fritsch and Maniatis (eds), Molecular Cloning; A Laboratory Manual, Second Edition, Cold Spring Harbor, N.Y., (1989), Ausubel, F. M. et al. (eds.) Current Protocols in Molecular Biology, Greene Publishing Associates, (1989) and in U.S. Pat. No. 4,816,397 by Boss et al.

In addition, the nucleic acid sequences encoding variable regions of the heavy and/or light chains can be converted, for example, to nucleic acid sequences encoding full-length antibody chains, Fab fragments, or to scFv. The VL- or VH-encoding DNA fragment can be operatively linked, (such that the amino acid sequences encoded by the two DNA fragments are in-frame) to another DNA fragment encoding, for example, an antibody constant region or a flexible linker. The sequences of human heavy chain and light chain constant regions are known in the art (see e.g., Kabat, E. A., et al. (1991) Sequences of Proteins of Immunological Interest, Fifth Edition, U.S. Department of Health and Human Services, NIH Publication No. 91-3242) and DNA fragments encompassing these regions can be obtained by standard PCR amplification.

To create a polynucleotide sequence that encodes a scFv, the VH- and VL-encoding nucleic acids can be operatively linked to another fragment encoding a flexible linker such that the VH and VL sequences can be expressed as a contiguous single-chain protein, with the VL and VH regions joined by the flexible linker (see e.g., Bird et al. (1988) Science 242: 423-426; Huston et al. (1988) Proc. Natl. Acad. Sci. USA 85:5879-5883; McCafferty et al., Nature (1990) 348:552-554).

To express the antibodies, antigen binding portions or derivatives thereof standard recombinant DNA expression methods can be used (see, for example, Goeddel; Gene Expression Technology. Methods in Enzymology 185, Academic Press, San Diego, Calif. (1990)). For example, DNA encoding the desired polypeptide can be inserted into an expression vector which is then transfected into a suitable host cell. In some embodiments, the DNAs encoding the heavy and light chains are inserted into separate vectors. In other embodiments, the DNA encoding the heavy and light chains are inserted into the same vector. It is understood that the design of the expression vector, including the selection of regulatory sequences is affected by factors such as the choice of the host cell, the level of expression of protein desired and whether expression is constitutive or inducible.

Preferred regulatory sequences for mammalian host cell expression include viral elements that direct high levels of protein expression in mammalian cells, such as promoters and/or enhancers derived from cytomegalovirus (CMV) (such as the CMV promoter/enhancer), Simian Virus 40 (SV40) (such as the SV40 promoter/enhancer), adenovirus, (e.g., the adenovirus major late promoter (AdMLP)) and polyoma. For further description of viral regulatory elements, and sequences thereof, see e.g., U.S. Pat. No. 5,168,062 by Stinski, U.S. Pat. No. 4,510,245 by Bell et al. and U.S. Pat. No. 4,968,615 by Schaffner et al. The recombinant expression vectors can also include origins of replication and selectable markers (see e.g., U.S. Pat. Nos. 4,399,216, 4,634,665 and U.S. Pat. No. 5,179,017, by Axel et al.). Suitable selectable markers include genes that confer resistance to drugs such as G418, hygromycin or methotrexate, on a host cell into which the vector has been introduced. For example, the dihydrofolate reductase (DHFR) gene confers resistance to methotrexate and the neo gene confers resistance to G418.

Transfection of the expression vector into a host cell can be carried out using standard techniques such as electroporation, calcium-phosphate precipitation, and DEAE-dextran transfection.

Suitable mammalian host cells for expressing the antibodies, antigen binding portions, or derivatives thereof provided herein include Chinese Hamster Ovary (CHO cells) (including dhfr-CHO cells, described in Urlaub and Chasin, (1980) Proc. Natl. Acad. Sci. USA 77:4216-4220, used with a DHFR selectable marker, e.g., as described in R. J. Kaufman and P. A. Sharp (1982) Mol. Biol. 159:601-621), NSO myeloma cells, COS cells and SP2 cells. In some embodiments, the expression vector is designed such that the expressed protein is secreted into the culture medium in which the host cells are grown. The antibodies, antigen binding portions, or derivatives thereof can be recovered from the culture medium using standard protein purification methods.

The antibodies, antigen binding portions, or derivatives thereof can also be produced in prokaryotic cells using suitable vectors as described, for example, in U.S. Pat. No. 6,204,023 to Robinson, et al and in (Carter et al., Bio/Technology 10:163-167 (1992). The expression vector can be designed to allow the expressed polypeptide to be secreted into the periplasmic space of gram-negative bacteria, or the extracellular space of gram-positive bacteria or yeasts, or the polypeptide can be retained within the cell, for example, in inclusion bodies. It is well-known to anyone skilled in the are that the sequences provided herein for heavy and light chain antibodies and fragments thereof can be operatively linked to functional elements that direct the expression to the respective spaces, such functional elements comprising for example leader sequences. The expressed polypeptide can be isolated from the periplasmic space or the inclusion bodies can be isolated from the host cell, respectively. For example, Fab'-SH fragments can be directly recovered from $E.\ coli$ and chemically coupled to form $F(ab')_2$ fragments (Carter et al., (1992)). In another embodiment, the antibodies, antigen binding portions, or derivatives thereof may be produced by homologous recombination, e.g. as described in U.S. Pat. No. 5,204,244.

Suitable host cells for cloning or expressing the DNA in the vectors herein are the prokaryote, yeast, or higher eukaryote cells described above. In addition to prokaryotes, eukaryotic microbes such as filamentous fungi or yeast are suitable cloning or expression hosts for the antibodies, antigen binding portions, or derivatives thereof provided herein. *Saccharomyces cerevisiae*, is a suitable eukaryotic host microorganism. Another suitable yeast host is *Schizosaccharomyces pombe*. Suitable host cells for the expression of glycosylated antibodies, antigen binding portions, or derivatives thereof provided herein include mammalian, plant, and insect cells. The antibodies, antigen binding portions, or derivatives thereof can be recovered from the culture medium using standard protein purification methods, including but not limiting to hydroxylapatite chromatography, gel electrophoresis, dialysis, recombinant tag purification (such as HA-tag, Myc-tag, His-tag) and affinity chromatography.

Host cells are transformed with the above-described expression or cloning vectors for antibodies, antigen binding portions, or derivatives thereof production and cultured in conventional nutrient media modified as appropriate for inducing promoters, selecting transformants, or amplifying the genes encoding the desired sequences. Commercially available media such as Ham's F10, Minimal Essential Medium (MEM), RPMI-1640, and Dulbecco's Modified Eagle's Medium (DMEM), are suitable for culturing the host cells. The culture conditions, such as temperature, pH, and the like, are those previously used with the host cell selected for expression, and will be apparent to the ordinarily skilled artisan.

When using recombinant techniques, the antibody can be produced intracellularly, in the periplasmic space, or directly secreted into the medium. If the antibody is produced intracellularly, as a first step, the particulate debris, either host cells or lysed fragments, is removed, for example, by centrifugation or ultrafiltration. Carter et al., Bio/Technology 10:163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody composition prepared from the cells can be purified using, for example, ion exchange chromatography, hydrophobic interaction chromatography, size exclusion chromatography, hydroxylapatite chromatography, gel electrophoresis, dialysis, and affinity chromatography.

The antibodies, antigen binding fragments thereof and derivatives thereof are shown to bind TNF-α by ELISA assay and/or HTRF assay, other assay formats known to anyone skilled in the art can be applied as well. Many of the antibodies, antigen binding fragments thereof and derivatives thereof provided herein bind to TNF-α at least as well as a Fab fragment of the anti-TNFα monoclonal antibody D2E7 (comprising SEQ ID NO. 1 and SEQ ID NO. 2). The assays demonstrate that many of the variants have a reduced off-rate compared to the antigen binding fragment of D2E7.

The antibodies, antigen binding portions, or derivatives thereof provided herein can be administered to a patient in need thereof. A variety of routes can be used to administer the antibody, antigen binding portion or derivative thereof. Any mode of administration that is medically acceptable, meaning any mode that produces effective levels of the active compounds without causing clinically unacceptable adverse effects can be used to administer the antibody, antigen binding portion or derivative thereof. Such modes of administration include oral, sublingual, topical, nasal, transdermal or parenteral routes. The term "parenteral" includes subcutaneous, intravenous, intramuscular, or infusion.

The antibody, antigen binding portion or derivative thereof can be administered once, continuously, such as by continuous pump, or at periodic intervals. The periodic interval may be weekly, bi-weekly, or monthly. The dosing can occur over the period of one month, two months, three months or more to elicit an appropriate humoral, cellular immune and/or clinical response. Desired time intervals of multiple doses of a particular composition can be determined without undue experimentation by one skilled in the art. Other protocols for the administration of an antibody or antigen binding fragment thereof will be known to one of ordinary skill in the art, in which the dose amount, schedule of administration, sites of administration, mode of administration and the like vary from the foregoing.

In yet another embodiment, the antibodies, antigen binding portions, or derivatives thereof provided herein can be used to detect TNFα in a biological sample, in vivo, ex vivo or in vitro. Suitable biological samples include, e.g., a tissue sample, a body fluid sample or a cell sample that is expected to contain TNFα. This can be achieved, for example, by contacting a sample to be tested, optionally along with a control sample, with the antibody, antigen binding portion, or derivative thereof under conditions that allow for formation of a complex between the antibody and TNFα, if present in the sample. Complex formation can then be detected, for example using enzyme linked immunosorbant assay (ELISA).

In one embodiment, an isolated antibody or antigen binding portion or derivative thereof capable of binding TNF-α wherein the antibody or antigen binding portion or derivative thereof comprises a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P. Yet another embodiment is the aforementioned isolated antibody or antigen binding portion or derivative thereof wherein the alterations in SEQ ID NO. 1 are selected from the group consisting of D31G, D31T, D31N, D31R, Y32F, Y32Q, and A40V, and further comprising a light chain comprising an amino acid sequence of SEQ ID NO. 2 having at least one alteration selected from the group consisting of T129A, Q166R, and T180I.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is H and residue 32 of SEQ ID NO. 1 is F.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is G and residue 32 of SEQ ID NO. 1 is F or Q.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 32 of SEQ ID NO. 1 is S.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is T and residue 32 of SEQ ID NO. 1 is F.

Furthermore, another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is Q and further comprising a light chain having SEQ ID NO. 2 wherein residue 180 of SEQ ID NO. 2 is I.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is N.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is N and residue 32 of SEQ ID NO. 1 is S or F. A further embodiment is the aforementioned isolated antibody or antigen binding portion or derivative thereof capable of binding TNF-α further comprising a light chain having a sequence of SEQ ID NO. 2, wherein residue 166 of SEQ ID NO. 2 is R.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is H and further comprising a light chain having a sequence of SEQ ID NO. 2, wherein residue 40 of SEQ ID NO. 2 is V and residue 129 of SEQ ID NO. 2 is A.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is T and residue 32 of SEQ ID NO. 1 is F.

Another embodiment is the aforementioned isolated antibody or antigen binding portion or derivative thereof comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is G and residue 32 of SEQ ID NO. 1 is F.

Another embodiment is the aforementioned isolated antibody comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 31 of SEQ ID NO. 1 is R.

Another embodiment is the aforementioned isolated antibody comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 50 of SEQ ID NO. 1 is G.

Another embodiment is the aforementioned isolated antibody comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 58 of SEQ ID NO. 1 is T or V.

Another embodiment is the aforementioned isolated antibody comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein residue 103 or SEQ ID NO. 1 is P.

Another embodiment is the aforementioned isolated antibody comprising a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P wherein the heavy chain further comprising at least one alteration selected from the group consisting of D31H, D31Q, Y32S, and S100K.

Another embodiment is the aforementioned isolated antibody comprising a heavy chain comprising an amino acid sequence of SEQ ID NO. 1 having at least one alteration selected from the group consisting of Q3R, D31 G, D31N, D31 T, D31R, Y32F, Y32Q, M34I, A40R, A50G, I58T, I58V, E65R, G66N, and S103P having a $K_D$ dissociation constant or a $K_{off}$ rate constant that is at least 1.5 fold lower than that of an antibody or antigen binding fragment thereof that comprises a heavy chain having the amino acid sequence of SEQ ID NO. 1 and a light chain having the amino acid sequence of SEQ ID NO. 2.

Another embodiment is a nucleic acid encoding an isolated antibody or antigen binding portion or derivative thereof capable of binding TNF-α wherein the antibody or antigen binding portion or derivative thereof comprises a heavy chain comprising an amino acid sequence of SEQ ID NO. 1 having at least one alteration selected from the group consisting of Q3R, D31G, D31N, D31T, D31R, Y32F, Y32Q, M34I, A40R, A50G, I58T, I58V, E65R, G66N, and S103P. A further embodiment is a vector comprising the aforementioned nucleic acid. Yet a further embodiment is a host cell comprising the aforementioned nucleic acid.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G. Furthermore, an embodiment is the aforementioned isolated antibody or antigen binding portion or derivative wherein the alterations in SEQ ID NO. 2 are selected from the group consisting of R24L, R24A, R24T, R25S, R25G, R25T, S26T, Q27M, Q27V, Q27W, G28S, G28P, G28R, G28L, and I29V.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of R24L, R24A, R24T, R25S, R25G, R25T, S26T, Q27M, Q27V, Q27W, G28S, G28P, G28R, G28L, and I29V wherein residue 24 of SEQ ID NO. 2 is L and residue 25 of SEQ ID NO. 2 is S or G. A further embodiment is the aforementioned antibody wherein residue 25 of SEQ ID NO. 2 is S and wherein residue 29 of SEQ ID NO. 2 is L.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of R24L, R24A, R24T, R25S, R25G, R25T, S26T, Q27M, Q27V, Q27W, G28S, G28P, G28R, G28L, and I29V wherein residue 24 of SEQ ID NO. 2 is A or T.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of R24L, R24A, R24T, R25S, R25G, R25T, S26T, Q27M, Q27V, Q27W, G28S, G28P, G28R, G28L, and I29V wherein residue 25 of SEQ ID NO. 2 is S or T. Yet a further embodiment is the aforementioned antibody wherein residue 27 of SEQ ID NO. 2 is M.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of R24L, R24A, R24T, R25S, R25G, R25T, S26T, Q27M, Q27V, Q27W, G28S, G28P, G28R, G28L, and I29V wherein residue 27 of SEQ ID NO. 2 is Y, V, or W. A further embodiment is the aforementioned isolated antibody or antigen binding portion or derivative thereof wherein residue 26 of SEQ ID NO. 2 is T.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of R24L, R24A, R24T, R25S, R25G, R25T, S26T, Q27M, Q27V, Q27W, G28S, G28P, G28R, G28L, and I29V wherein residue 28 of SEQ ID NO. 2 is S, P, R, or L. A further embodiment is the aforementioned isolated antibody or antigen binding portion or derivative thereof wherein residue 29 of SEQ ID NO. 2 is L or V.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N. A further embodiment is the aforementioned isolated antibody or antigen binding portion or derivative wherein residue 53 of SEQ ID NO. 2 is W.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ II) NO. 1 having at least one alteration selected from the group consisting of E65R and G66N wherein residue 52 of SEQ ID NO 2. is W, G, or N.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N wherein residue 52 of SEQ ID NO. 2 is N and residue 53 of SEQ ID NO. 2 is Y, F, or V.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N wherein residue 53 of SEQ ID NO. 2 is Y, F, or V and residue 57 of SEQ ID NO. 2 is S.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N wherein residue 53 of SEQ ID NO. 2 is S and residue 214 of SEQ ID NO. 2 is G and further comprising a heavy chain having an amino acid sequence of SEQ ID NO. 1 wherein residue 65 is R and residue 66 is N.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N residue 54 of SEQ ID NO. 2 is S, or T. A further embodiment is the aforementioned isolated antibody or antigen binding portion or derivative thereof wherein residue 55 of SEQ ID NO. 2 is I, K, or L.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N wherein residue 56 of SEQ ID NO. 2 is R.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V. Yet a further embodiment is the aforementioned isolated antibody or antigen binding portion or derivative thereof wherein residue 15 of SEQ ID NO. 2 is M, residue 94 of SEQ ID NO. 2 is P, and residue 95 of SEQ ID NO. 2 is M.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V wherein residue 92 of SEQ ID NO. 2 is I. A further embodiment is the aforementioned isolated antibody or antigen binding portion or derivative thereof wherein residue 93 of SEQ ID NO. 2 is Q and residue 94 of SEQ ID NO. 2 is P.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V wherein residue 92 of SEQ ID NO. 2 is D and residue 93 of SEQ ID NO. 2 is M.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V wherein residue 93 of SEQ ID NO. 2 is M. A further embodiment is the aforementioned isolated antibody or antigen binding portion or derivative thereof wherein residue 94 of SEQ ID NO. 2 is P.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V wherein residue 93 of SEQ ID NO. 2 is Q. A further embodiment is the aforementioned isolated antibody or antigen binding portion or derivative thereof wherein residue 94 of SEQ ID NO. 2 is P.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V residue 93 of SEQ ID NO. 2 is K and residue 94 of SEQ ID NO. 2 is S.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, T180I, V196A, and C214G wherein the alterations in SEQ ID NO. 2 are selected from the group consisting of V15M, N92I, R93Q, R93M, A94S, P95Q, P95A, P95S, P95M, P95E, and P95V wherein residue 94 of SEQ ID NO. 2 is P and residue 95 of SEQ ID NO. 2 is selected from the group consisting of Q, A, S, M, E, and V.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N, the light chain further comprising at least one alteration selected from the group consisting of Q27L, Q27Y, Q27K, I29L, T53S, Q55L, N92D, R93K and A94P.

Another embodiment is an isolated antibody or antigen binding portion or derivative thereof capable of binding TNF-α wherein the antibody or antigen binding portion or derivative thereof comprises a light chain comprising an amino acid sequence of SEQ ID NO. 2 having at least one alteration selected from the group consisting of S52N, S52G, S52W, T53W, T53Y, T53G, T53F, T53V, L54S, L54T, Q55I, Q55K, S56R, G57S, and C214G and further comprising a heavy chain comprising an amino acid sequence of SEQ ID NO. 1 having at least one alteration selected from the group consisting of E65R and G66N wherein the aforementioned isolated antibody or antigen binding portion thereof having a $K_D$ dissociation constant or a $K_{off}$ rate constant that is at least 1.5 fold lower than that of an antibody or antigen binding fragment thereof that comprises a heavy chain having the amino acid sequence of SEQ ID NO. 1 and a light chain having the amino acid sequence of SEQ ID NO. 2.

Another embodiment is an isolated antibody or antigen binding portion thereof capable of binding TNF-α wherein the antibody or antigen binding portion thereof comprises a heavy chain comprising an amino acid sequence of SEQ ID NO. 1 having at least one alteration in the sequence selected from the group consisting of Q3R, D31G, D31N, D31T, D31R, Y32F, Y32Q, M34I, A40V, A50G, I58T, I58V, E65R, G66N, and S103P and a light chain comprising an amino acid sequence of SEQ ID NO. 2 having at least one alteration in the sequence selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, V196A T180I, and C214G. A further embodiment is the aforementioned isolated antibody or antigen binding portion thereof having a $K_D$ dissociation constant or a $K_{off}$ rate constant that is at least 1.5 fold lower than that of an antibody or antigen binding fragment thereof that comprises a heavy chain having the amino acid sequence of SEQ ID NO. 1 and a light chain having the amino acid sequence of SEQ ID NO. 2.

Another embodiment is an isolated antibody or antigen binding portion thereof capable of binding TNF-α wherein the antibody or antigen binding portion thereof comprises a heavy chain comprising an amino acid sequence of SEQ ID NO. 1 having at least one alteration in the sequence selected from the group consisting of Q3R, D31G, D31N, D31T, D31R, Y32F, Y32Q, M34I, A40V, A50G, I58T, I58V, E65R, G66N, and S103P and a light chain comprising an amino acid sequence of SEQ ID NO. 2 having at least one alteration in the sequence selected from the group consisting of V15M, R24L, R24A, R24T, R25S, R25G, R25T, S26T, Q27M, Q27V, Q27W, G28S, G28P, G28R, G28L, I29V, Y49S, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, P95V, T129A, Q166R, V196A T180I, and C214G, wherein the light chain has at least one alteration in the sequence selected from the group consisting of S52N, S52G, S52W, T53W, V58M, N92I, R93K, R93Q and A94P. A further embodiment is the aforementioned isolated antibody or antigen binding portion thereof, wherein the heavy chain has at least one alteration in the sequence selected from the group consisting of D31H, D31Q, Y32F, and Y32S.

Another embodiment is an isolated antibody or antigen binding portion thereof capable of binding TNF-α wherein the antibody or antigen binding portion thereof comprises a heavy chain CDR1 region comprising amino acids 31-35 of SEQ ID NO. 1, a heavy chain CDR2 region comprising amino acids 50-66 of SEQ ID NO. 1 and a heavy chain CDR3 region comprising amino acids 99-100 of SEQ ID NO. 1 and having at least one alteration selected from the group consisting of D31G, D31N, D31T, D31R, Y32F, Y32Q, M34I, A50G, I58T, I58V, E65R, G66N, and S103P and wherein the antibody or antigen binding portion thereof comprises a light chain CDR1 region comprising amino acids 24-34 of SEQ ID NO. 2, a light chain CDR2 region comprising amino acids 50-56 of SEQ ID NO. 2 and a light chain CDR3 region comprising amino acids 89-97 of SEQ ID NO. 2 having at least one alteration selected from the group consisting of R24L, R24A, R24T, R25S, R25G, R25T, S26T, Q27M, Q27V, Q27W, G28S, G28P, G28R, G28L, I29V, S52N, S52G, S52W, T53W, T53Y, T53G, T53F, T53V, L54S, L54T, Q55I, Q55K, S56R, G57S, V58M, N92I, R93Q, R93M, A94S, P95Q, P95A, P95S, P95M, P95E, and P95V.

Another embodiment is an isolated antibody or antigen binding portion thereof capable of binding TNF-α wherein the $V_h$ (variable heavy chain) antibody chain comprising at least one of the $V_h$ CDR1, CDR2 and CDR3 regions whose sequences are identified by SEQ ID NO: 43, 44, and 45 respectively and wherein the $V_l$ (variable light chain) antibody chain comprising at least one of the $V_h$ CDR1, CDR2 and CDR3 regions whose sequences are identified by SEQ ID NO: 49, 50 and 51, respectively, excluding an isolated antibody or antigen binding portion thereof capable of binding TNF-α wherein the $V_h$ antibody chain comprising at least one of the $V_h$ CDR1, CDR2 and CDR3 regions whose sequences are identified by SEQ ID NO: 46, 47, and 48 respectively and wherein the $V_l$ antibody chain comprising at least one of the $V_l$ CDR1, CDR2 and CDR3 regions whose sequences are identified by SEQ ID NO: 52, 53 and 54, respectively. A further embodiment is an aforementioned isolated antibody or antigen binding portion thereof capable of binding TNF-α with an affinity constant $K_D$ or $k_{off}$ rate constant that is at least 3 fold lower than that of the antibody having a heavy chain and a light chain identified by SEQ ID NO: 463 and SEQ ID NO: 464, respectively. A further preferred embodiment is an aforementioned isolated antibody or antigen binding portion thereof capable of binding TNF-α with an affinity constant $K_D$ of less than 30 pM, more preferably of less or equal than 10 pM.

Another embodiment is an isolated antibody or antigen binding portion thereof capable of binding TNF-α wherein the $V_h$ antibody chain comprising the $V_h$ CDR1, CDR2 and CDR3 regions whose sequences are identified by SEQ ID NO: 43, 44, and 45 respectively and wherein the $V_l$ antibody chain comprising the $V_l$ CDR1, CDR2 and CDR3 regions whose sequences are identified by SEQ ID NO: 49, 50 and 51, respectively, excluding an isolated antibody or antigen binding portion thereof capable of binding TNF-α wherein the $V_h$ antibody chain comprising at least one of the $V_h$ CDR1, CDR2 and CDR3 regions whose sequences are identified by SEQ ID NO: 46, 47, and 48 respectively and wherein the $V_l$ antibody chain comprising at least one of the $V_l$ CDR1, CDR2 and CDR3 regions whose sequences are identified by SEQ ID NO: 52, 53 and 54, respectively.

Another embodiment is an isolated antibody or antigen binding portion thereof capable of binding TNF-α wherein the $V_h$ antibody chain comprising at least one of the $V_h$ CDR1, CDR2 and CDR3 regions whose sequences are identified by SEQ ID NO: 43, 44, and 45 respectively and wherein the $V_l$ antibody chain comprising at least one of the $V_l$ CDR1, CDR2 and CDR3 regions whose sequences are identified by SEQ ID NO: 49, 50 and 51, respectively, and wherein the heavy chain $V_h$ region has a G at position 30. Position 30 of the $V_h$ region is defined by standard numbering (see e.g., Kabat, E. A., et al. (1991) Sequences of Proteins of Immunological Interest, Fifth Edition, U.S. Department of Health and Human Services, NIH Publication No. 91-3242).

Another embodiment is an isolated antibody or antigen binding portion thereof capable of binding TNF-α wherein the $V_h$ antibody chain comprising the $V_h$ CDR1, CDR2 and CDR3 regions whose sequences are identified by SEQ ID NO: 43, 44, and 45 respectively and wherein the $V_l$ antibody chain comprising the $V_l$ CDR1, CDR2 and CDR3 regions whose sequences are identified by SEQ ID NO: 49, 50 and 51, respectively, and wherein the heavy chain $V_h$ region has a G at position 30. Position 30 of the $V_h$ region is defined by standard numbering (see e.g., Kabat, E. A., et al. (1991) Sequences of Proteins of Immunological Interest, Fifth Edition, U.S. Department of Health and Human Services, NIH Publication No. 91-3242).

Another embodiment is an isolated antibody or antigen binding portion thereof capable of binding TNF-α wherein the $V_h$ antibody chain comprising the $V_h$ CDR1 region whose sequence is identified by SEQ ID NO: 55.

Another embodiment is an isolated antibody or antigen binding portion thereof capable of binding TNF-α wherein the $V_h$ antibody chain comprising the $V_h$ CDR1 region whose sequence is identified by SEQ ID NO: 55 and wherein the heavy chain $V_h$ region has a G at position 30. Position 30 of the $V_h$ region is defined by standard numbering (see e.g., Kabat, E. A., et al. (1991) Sequences of Proteins of Immunological Interest, Fifth Edition, U.S. Department of Health and Human Services, NIH Publication No. 91-3242).

Another embodiment is an isolated antibody or antigen binding portion thereof capable of binding TNF-α wherein the $V_h$ antibody chain comprising the $V_h$ CDR1 region whose sequence is identified by SEQ ID NO: 55 and wherein the $V_l$ antibody chain comprising at least one of the $V_l$ CDR1, CDR2 and CDR3 regions whose sequences are identified by SEQ ID NO: 49, 50 and 51, respectively.

Another embodiment is an isolated antibody or antigen binding portion thereof capable of binding TNF-α wherein the $V_h$ antibody chain comprising the $V_h$ CDR1 region whose sequence is identified by SEQ ID NO: 55 and wherein the $V_l$ antibody chain comprising at least one of the $V_l$ CDR1, CDR2 and CDR3 regions whose sequences are identified by SEQ ID NO: 49, 50 and 51, respectively, and wherein the heavy chain $V_h$ region has a G at position 30. Position 30 of the $V_h$ region is defined by standard numbering (see e.g., Kabat, E. A., et al. (1991) Sequences of Proteins of Immunological Interest, Fifth Edition, U.S. Department of Health and Human Services, NIH Publication No. 91-3242).

Another embodiment is an isolated antibody or antigen binding portion thereof capable of binding TNF-α wherein the $V_l$ antibody chain comprising the $V_l$ CDR3 region whose sequence is identified by SEQ ID NO: 56.

Another embodiment is an isolated antibody or antigen binding portion thereof capable of binding TNF-α wherein the $V_h$ antibody chain comprising at least one of the $V_h$ CDR1, CDR2 and CDR3 regions whose sequences are identified by SEQ ID NO: 43, 44, and 45 respectively and wherein the $V_l$ antibody chain comprising the $V_l$ CDR3 regions whose sequence is identified by SEQ ID NO: 56.

Another embodiment is an isolated antibody or antigen binding portion thereof capable of binding TNF-α wherein the $V_h$ antibody chains comprise the sequence which is comprised in a group of sequences consisting of SEQ ID NO: 20, 21, 22, 23, 24, 25 and 26, excluding sequences identified by SEQ ID NO: 40.

Another embodiment is an isolated antibody or antigen binding portion thereof capable of binding TNF-α wherein the $V_h$ antibody chains comprise the sequence which is comprised in a group of sequences consisting of SEQ ID NO: 21, 22, 23, 24, 25 and 26.

Another embodiment is an isolated antibody or antigen binding portion thereof capable of binding TNF-α wherein the V$_h$ antibody chain comprises the sequence identified by SEQ ID NO: 20, excluding sequences identified by SEQ ID NO: 40.

Another embodiment is an isolated antibody or antigen binding portion thereof capable of binding TNF-α wherein the V$_h$ antibody chain comprises the sequence identified by SEQ ID NO: 21.

Another embodiment is an isolated antibody or antigen binding portion thereof capable of binding TNF-α wherein the V$_h$ antibody chain comprises the sequence identified by SEQ ID NO: 22.

Another embodiment is an isolated antibody or antigen binding portion thereof capable of binding TNF-α wherein the V$_h$ antibody chain comprises the sequence identified by SEQ ID NO: 23.

Another embodiment is an isolated antibody or antigen binding portion thereof capable of binding TNF-α wherein the V$_h$ antibody chain comprises the sequence identified by SEQ ID NO: 24.

Another embodiment is an isolated antibody or antigen binding portion thereof capable of binding TNF-α wherein the V$_h$ antibody chain comprises the sequence identified by SEQ ID NO: 25.

Another embodiment is an isolated antibody or antigen binding portion thereof capable of binding TNF-α wherein the V$_h$ antibody chain comprises the sequence identified by SEQ ID NO: 26.

Another embodiment is an isolated antibody or antigen binding portion thereof capable of binding TNF-α wherein the V$_l$ antibody chain comprises the sequence identified by SEQ ID NO: 27, excluding sequences identified by SEQ ID NO: 42.

Another embodiment is an isolated antibody or antigen binding portion thereof capable of binding TNF-α wherein the V$_l$ antibody chain comprises the sequence identified by SEQ ID NO: 28.

Another embodiment is an isolated antibody or antigen binding portion thereof capable of binding TNF-α wherein the V$_l$ antibody chain comprises the sequence identified by SEQ ID NO: 29.

Another embodiment is an isolated antibody or antigen binding portion thereof capable of binding TNF-α wherein the V$_l$ antibody chain comprises the sequence identified by SEQ ID NO: 30.

Another embodiment is an isolated antibody or antigen binding portion thereof capable of binding TNF-α wherein the V$_l$ antibody chain comprises the sequence identified by SEQ ID NO: 31.

Another embodiment is an isolated antibody or antigen binding portion thereof capable of binding TNF-α wherein the V$_l$ antibody chain comprises the sequence identified by SEQ ID NO: 32.

Another embodiment is an isolated antibody or antigen binding portion thereof capable of binding TNF-α wherein the V$_l$ antibody chain comprises the sequence identified by SEQ ID NO: 33.

Another embodiment is an isolated antibody or antigen binding portion thereof capable of binding TNF-α wherein the V$_l$ antibody chain comprises the sequence identified by SEQ ID NO: 34.

Another embodiment is an isolated antibody or antigen binding portion thereof capable of binding TNF-α wherein the V$_l$ antibody chain comprises the sequence identified by SEQ ID NO: 37.

Another embodiment is an isolated antibody or antigen binding portion thereof capable of binding TNF-α wherein the V$_l$ antibody chain comprises the sequence identified by SEQ ID NO: 38.

Another embodiment is an isolated antibody or antigen binding portion thereof capable of binding TNF-α wherein the V$_h$ and V$_l$ antibody chains comprise the sequences which are comprised in a group of sequences consisting of SEQ ID NO: 20, 21, 22, 23, 24, 25 and 26 and which are comprised in a group of sequences consisting of SEQ ID NO: 27, 28, 29, 30, 31, 32, 33, 34, 37 and 38, respectively, excluding an isolated antibody or antigen binding portion thereof capable of binding TNF-α wherein the V$_h$ and V$_l$ chains comprise the sequences identified by SEQ ID NO: 40 and SEQ ID NO: 42, respectively.

Another embodiment is an isolated antibody or antigen binding portion thereof capable of binding TNF-α wherein the V$_h$ and V$_l$ antibody chains comprise the sequences identified by SEQ ID NO: 20 and SEQ ID NO: 27, respectively, excluding an isolated antibody or antigen binding portion thereof capable of binding TNF-α wherein the V$_h$ and V$_l$ chains comprise the sequences identified by SEQ ID NO: 40 and SEQ ID NO: 42, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 27, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 27, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 27, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 27, respectively.

Another embodiment is an isolated antibody or antigen binding portion thereof capable of binding TNF-α wherein the V$_h$ and V$_l$ antibody chains comprise the sequences identified by SEQ ID NO: 25 and SEQ ID NO: 27, respectively.

Another embodiment is an isolated antibody or antigen binding portion thereof capable of binding TNF-α wherein the V$_h$ and V$_l$ antibody chains comprise the sequences identified by SEQ ID NO: 26 and SEQ ID NO: 27, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 37, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 37, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 38, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 38, respectively.

Another embodiment is an isolated antibody or antigen binding portion thereof capable of binding TNF-α wherein the V$_h$ and V$_l$ antibody chains comprise the sequences identified by SEQ ID NO: 20 and SEQ ID NO: 31, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 31, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 31, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 31, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 31, respectively.

Another embodiment is an isolated antibody or antigen binding portion thereof capable of binding TNF-α wherein the V$_h$ and V$_l$ antibody chains comprise the sequences identified by SEQ ID NO: 20 and SEQ ID NO: 28, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 28, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 28, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 28, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 28, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 29, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 29, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 29, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 29, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 30, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 30, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 30, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 30, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 32, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 32, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 32, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 32, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 33, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 33, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 33, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 33, respectively.

Another embodiment is an isolated antibody or antigen binding portion thereof capable of binding TNF-α wherein the V$_h$ and V$_l$ antibody chains comprise the sequences identified by SEQ ID NO: 21 and SEQ ID NO: 34, respectively.

Another embodiment is an isolated antibody or antigen binding portion thereof capable of binding TNF-α wherein the V$_h$ and V$_l$ antibody chains comprise the sequences identified by SEQ ID NO: 22 and SEQ ID NO: 34, respectively.

Another embodiment is an isolated antibody or antigen binding portion thereof capable of binding TNF-α wherein the V$_h$ and V$_l$ antibody chains comprise the sequences identified by SEQ ID NO: 23 and SEQ ID NO: 34, respectively.

Another embodiment is an isolated antibody or antigen binding portion thereof capable of binding TNF-α wherein the V$_h$ and V$_l$ antibody chains comprise the sequences identified by SEQ ID NO: 24 and SEQ ID NO: 34, respectively.

Another embodiment is an isolated antibody or antigen binding portion thereof capable of binding TNF-α wherein the antibody heavy chain comprises the sequence identified by SEQ ID NO: 5, excluding sequences identified by SEQ ID NO: 39.

Another embodiment is an isolated antibody or antigen binding portion thereof capable of binding TNF-α wherein the Antibody heavy chain comprises the sequence identified by SEQ ID NO: 6.

Another embodiment is an isolated antibody or antigen binding portion thereof capable of binding TNF-α wherein the Antibody heavy chain comprises the sequence identified by SEQ ID NO: 7.

Another embodiment is an isolated antibody or antigen binding portion thereof capable of binding TNF-α wherein the Antibody heavy chain comprises the sequence identified by SEQ ID NO: 8.

Another embodiment is an isolated antibody or antigen binding portion thereof capable of binding TNF-α wherein the Antibody heavy chain comprises the sequence identified by SEQ ID NO: 9.

Another embodiment is an isolated antibody or antigen binding portion thereof capable of binding TNF-α wherein the Antibody heavy chain comprises the sequence identified by SEQ ID NO: 10.

Another embodiment is an isolated antibody or antigen binding portion thereof capable of binding TNF-α wherein the Antibody heavy chain comprises the sequence identified by SEQ ID NO: 11.

Another embodiment is an isolated antibody or antigen binding portion thereof capable of binding TNF-α wherein the Antibody light chain comprises the sequence identified by SEQ ID NO: 12, excluding sequences identified by SEQ ID NO: 41.

Another embodiment is an isolated antibody or antigen binding portion thereof capable of binding TNF-α wherein the Antibody light chain comprises the sequence identified by SEQ ID NO: 13.

Another embodiment is an isolated antibody or antigen binding portion thereof capable of binding TNF-α wherein the Antibody light chain comprises the sequence identified by SEQ ID NO: 14.

Another embodiment is an isolated antibody or antigen binding portion thereof capable of binding TNF-α wherein the Antibody light chain comprises the sequence identified by SEQ ID NO: 15.

Another embodiment is an isolated antibody or antigen binding portion thereof capable of binding TNF-α wherein the Antibody light chain comprises the sequence identified by SEQ ID NO: 16.

Another embodiment is an isolated antibody or antigen binding portion thereof capable of binding TNF-α wherein the Antibody light chain comprises the sequence identified by SEQ ID NO: 17.

Another embodiment is an isolated antibody or antigen binding portion thereof capable of binding TNF-α wherein the Antibody light chain comprises the sequence identified by SEQ ID NO: 18.

Another embodiment is an isolated antibody or antigen binding portion thereof capable of binding TNF-α wherein the Antibody light chain comprises the sequence identified by SEQ ID NO: 19.

Another embodiment is an isolated antibody or antigen binding portion thereof capable of binding TNF-α wherein the Antibody light chain comprises the sequence identified by SEQ ID NO: 36.

Another embodiment is an isolated antibody or antigen binding portion thereof capable of binding TNF-α wherein the Antibody light chain comprises the sequence identified by SEQ ID NO: 35.

Another embodiment is an isolated antibody or antigen binding portion thereof capable of binding TNF-α wherein the Antibody heavy and light chains comprise the sequences which are comprised in a group of sequences consisting of SEQ ID NO: 5, 6, 7, 8, 9, 10 and 11 and which are comprised in a group of sequences consisting of SEQ ID NO: 12, 13, 14, 15, 16, 17, 18 19, 35 and 36, respectively, excluding an isolated antibody or antigen binding portion thereof capable of binding TNF-α wherein the heavy and light chains comprise the sequences identified by SEQ ID NO: 39 and SEQ ID NO: 41, respectively.

Another embodiment is an isolated antibody or antigen binding portion thereof capable of binding TNF-α wherein the Antibody heavy and light chains comprise the sequences identified by SEQ ID NO: 5 and SEQ ID NO: 12, respectively, excluding an isolated antibody or antigen binding portion thereof capable of binding TNF-α wherein the heavy and light chains comprise the sequences identified by SEQ ID NO: 39 and SEQ ID NO: 41, respectively.

Another embodiment is an isolated antibody or antigen binding portion thereof capable of binding TNF-α wherein the Antibody heavy and light chains comprise the sequences identified by SEQ ID NO: 6 and SEQ ID NO: 12, respectively.

Another embodiment is an isolated antibody or antigen binding portion thereof capable of binding TNF-α wherein the Antibody heavy and light chains comprise the sequences identified by SEQ ID NO: 7 and SEQ ID NO: 12, respectively.

Another embodiment is an isolated antibody or antigen binding portion thereof capable of binding TNF-α wherein the Antibody heavy and light chains comprise the sequences identified by SEQ ID NO: 8 and SEQ ID NO: 12, respectively.

Another embodiment is an isolated antibody or antigen binding portion thereof capable of binding TNF-α wherein the Antibody heavy and light chains comprise the sequences identified by SEQ ID NO: 9 and SEQ ID NO: 12, respectively.

Another embodiment is an isolated antibody or antigen binding portion thereof capable of binding TNF-α wherein the Antibody heavy and light chains comprise the sequences identified by SEQ ID NO: 10 and SEQ ID NO: 12, respectively.

Another embodiment is an isolated antibody or antigen binding portion thereof capable of binding TNF-α wherein the Antibody heavy and light chains comprise the sequences identified by SEQ ID NO: 11 and SEQ ID NO: 12, respectively.

Another embodiment is an isolated antibody or antigen binding portion thereof capable of binding TNF-α wherein the Antibody heavy and light chains comprise the sequences identified by SEQ ID NO: 8 and SEQ ID NO: 35, respectively.

Another embodiment is an isolated antibody or antigen binding portion thereof capable of binding TNF-α wherein the Antibody heavy and light chains comprise the sequences identified by SEQ ID NO: 9 and SEQ ID NO: 35, respectively.

Another embodiment is an isolated antibody or antigen binding portion thereof capable of binding TNF-α wherein the Antibody heavy and light chains comprise the sequences identified by SEQ ID NO: 8 and SEQ ID NO: 36, respectively.

Another embodiment is an isolated antibody or antigen binding portion thereof capable of binding TNF-α wherein the Antibody heavy and light chains comprise the sequences identified by SEQ ID NO: 9 and SEQ ID NO: 36, respectively.

Another embodiment is an isolated antibody or antigen binding portion thereof capable of binding TNF-α wherein the heavy and light antibody chains comprise the sequences identified by SEQ ID NO: 5 and SEQ ID NO: 16, respectively.

Another embodiment is an isolated antibody or antigen binding portion thereof capable of binding TNF-α wherein the heavy and light antibody chains comprise the sequences identified by SEQ ID NO: 6 and SEQ ID NO: 16, respectively.

Another embodiment is an isolated antibody or antigen binding portion thereof capable of binding TNF-α wherein the heavy and light antibody chains comprise the sequences identified by SEQ ID NO: 7 and SEQ ID NO: 16, respectively.

Another embodiment is an isolated antibody or antigen binding portion thereof capable of binding TNF-α wherein the heavy and light antibody chains comprise the sequences identified by SEQ ID NO: 8 and SEQ ID NO: 16, respectively.

Another embodiment is an isolated antibody or antigen binding portion thereof capable of binding TNF-α wherein the heavy and light antibody chains comprise the sequences identified by SEQ ID NO: 9 and SEQ ID NO: 16, respectively.

Another embodiment is an isolated antibody or antigen binding portion thereof capable of binding TNF-α wherein the heavy and light antibody chains comprise the sequences identified by SEQ ID NO: 5 and SEQ ID NO: 13, respectively.

Another embodiment is an isolated antibody or antigen binding portion thereof capable of binding TNF-α wherein the heavy and light antibody chains comprise the sequences identified by SEQ ID NO: 6 and SEQ ID NO: 13, respectively.

Another embodiment is an isolated antibody or antigen binding portion thereof capable of binding TNF-α wherein the heavy and light antibody chains comprise the sequences identified by SEQ ID NO: 7 and SEQ ID NO: 13, respectively.

Another embodiment is an isolated antibody or antigen binding portion thereof capable of binding TNF-α wherein the heavy and light antibody chains comprise the sequences identified by SEQ ID NO: 8 and SEQ ID NO: 13, respectively.

Another embodiment is an isolated antibody or antigen binding portion thereof capable of binding TNF-α wherein the heavy and light antibody chains comprise the sequences identified by SEQ ID NO: 9 and SEQ ID NO: 13, respectively.

Another embodiment is an isolated antibody or antigen binding portion thereof capable of binding TNF-α wherein the heavy and light antibody chains comprise the sequences identified by SEQ ID NO: 6 and SEQ ID NO: 14, respectively.

Another embodiment is an isolated antibody or antigen binding portion thereof capable of binding TNF-α wherein the heavy and light antibody chains comprise the sequences identified by SEQ ID NO: 7 and SEQ ID NO: 14, respectively.

Another embodiment is an isolated antibody or antigen binding portion thereof capable of binding TNF-α wherein the heavy and light antibody chains comprise the sequences identified by SEQ ID NO: 8 and SEQ ID NO: 14, respectively.

Another embodiment is an isolated antibody or antigen binding portion thereof capable of binding TNF-α wherein the heavy and light antibody chains comprise the sequences identified by SEQ ID NO: 9 and SEQ ID NO: 14, respectively.

Another embodiment is an isolated antibody or antigen binding portion thereof capable of binding TNF-α wherein the heavy and light antibody chains comprise the sequences identified by SEQ ID NO: 6 and SEQ ID NO: 15, respectively.

Another embodiment is an isolated antibody or antigen binding portion thereof capable of binding TNF-α wherein the heavy and light antibody chains comprise the sequences identified by SEQ ID NO: 7 and SEQ ID NO: 15, respectively.

Another embodiment is an isolated antibody or antigen binding portion thereof capable of binding TNF-α wherein the heavy and light antibody chains comprise the sequences identified by SEQ ID NO: 8 and SEQ ID NO: 15, respectively.

Another embodiment is an isolated antibody or antigen binding portion thereof capable of binding TNF-α wherein the heavy and light antibody chains comprise the sequences identified by SEQ ID NO: 9 and SEQ ID NO: 15, respectively.

Another embodiment is an isolated antibody or antigen binding portion thereof capable of binding TNF-α wherein the heavy and light antibody chains comprise the sequences identified by SEQ ID NO: 6 and SEQ ID NO: 17, respectively.

Another embodiment is an isolated antibody or antigen binding portion thereof capable of binding TNF-α wherein the heavy and light antibody chains comprise the sequences identified by SEQ ID NO: 7 and SEQ ID NO: 17, respectively.

Another embodiment is an isolated antibody or antigen binding portion thereof capable of binding TNF-α wherein the heavy and light antibody chains comprise the sequences identified by SEQ ID NO: 8 and SEQ ID NO: 17, respectively.

Another embodiment is an isolated antibody or antigen binding portion thereof capable of binding TNF-α wherein the heavy and light antibody chains comprise the sequences identified by SEQ ID NO: 9 and SEQ ID NO: 17, respectively.

Another embodiment is an isolated antibody or antigen binding portion thereof capable of binding TNF-α wherein the heavy and light antibody chains comprise the sequences identified by SEQ ID NO: 6 and SEQ ID NO: 18, respectively.

Another embodiment is an isolated antibody or antigen binding portion thereof capable of binding TNF-α wherein the heavy and light antibody chains comprise the sequences identified by SEQ ID NO: 7 and SEQ ID NO: 18, respectively.

Another embodiment is an isolated antibody or antigen binding portion thereof capable of binding TNF-α wherein the heavy and light antibody chains comprise the sequences identified by SEQ ID NO: 8 and SEQ ID NO: 18, respectively.

Another embodiment is an isolated antibody or antigen binding portion thereof capable of binding TNF-α wherein the heavy and light antibody chains comprise the sequences identified by SEQ ID NO: 9 and SEQ ID NO: 18, respectively.

Another embodiment is an isolated antibody or antigen binding portion thereof capable of binding TNF-α wherein the heavy and light antibody chains comprise the sequences identified by SEQ ID NO: 6 and SEQ ID NO: 19, respectively.

Another embodiment is an isolated antibody or antigen binding portion thereof capable of binding TNF-α wherein the heavy and light antibody chains comprise the sequences identified by SEQ ID NO: 7 and SEQ ID NO: 19, respectively.

Another embodiment is an isolated antibody or antigen binding portion thereof capable of binding TNF-α wherein the heavy and light antibody chains comprise the sequences identified by SEQ ID NO: 8 and SEQ ID NO: 19, respectively.

Another embodiment is an isolated antibody or antigen binding portion thereof capable of binding TNF-α wherein the heavy and light antibody chains comprise the sequences identified by SEQ ID NO: 9 and SEQ ID NO: 19, respectively.

Another embodiment is an isolated antibody or antigen binding portion thereof capable of binding TNF-α wherein $V_h$ antibody chain comprise the sequence which is comprised in a group of sequences consisting of SEQ ID NOs: 149, 265, 271, 291, 295, 303, 309, 313, 321, 359, 401, 402 and 453.

Another embodiment is an isolated antibody or antigen binding portion thereof capable of binding TNF-α wherein $V_l$ antibody chain comprise the sequence which is comprised in a group of sequences consisting of SEQ ID NOs: 150, 266, 272, 292, 296, 304, 310, 314, 322, 360 and 454.

Another embodiment is an isolated antibody or antigen binding portion thereof capable of binding TNF-α wherein $V_h$ and $V_l$ antibody chain comprise the sequence which is comprised in a group of sequences consisting of SEQ ID NOs: 149, 265, 271, 291, 295, 303, 309, 313, 321, 359, 401, 402 and 453 and which is comprised in a group of sequences consisting of SEQ ID NOs: 150, 266, 272, 292, 296, 304, 310, 314, 322, 360 and 454, repetively.

Another embodiment is an isolated antibody or antigen binding portion thereof capable of binding TNF-α wherein antibody heavy chain comprise the sequence which is comprised in a group of sequences consisting of SEQ ID NOs: 147, 263, 269, 289, 293, 301, 307, 311, 319, 357, 373 and 399.

Another embodiment is an isolated antibody or antigen binding portion thereof capable of binding TNF-α wherein antibody light chain comprise the sequence which is comprised in a group of sequences consisting of SEQ ID NOs: 148, 264, 270, 290, 294, 302, 308, 312, 320, 358, 374 and 400.

Another embodiment is an isolated antibody or antigen binding portion thereof capable of binding TNF-α wherein antibody heavy and light chains comprise the sequence which is comprised in a group of sequences consisting of SEQ ID NOs: 147, 263, 269, 289, 293, 301, 307, 311, 319, 357, 373 and 399 and which is comprised in a group of sequences consisting of SEQ ID NOs: 148, 264, 270, 290, 294, 302, 308, 312, 320, 358, 374 and 400, respectively.

Another preferred embodiment is an isolated antibody or antigen binding portion thereof capable of binding TNF-α wherein the $V_h$ and $V_l$ antibody chains comprise the sequences identified by SEQ ID NO: 149 and SEQ ID NO: 150, respectively.

Another preferred embodiment is an isolated antibody or antigen binding portion thereof capable of binding TNF-α wherein the heavy and light antibody chains comprise the sequences identified by SEQ ID NO: 147 and SEQ ID NO: 148, respectively.

Another preferred embodiment is an isolated antibody or antigen binding portion thereof capable of binding TNF-α wherein the $V_h$ and $V_l$ antibody chains comprise the sequences identified by SEQ ID NO: 265 and SEQ ID NO: 266, respectively.

Another preferred embodiment is an isolated antibody or antigen binding portion thereof capable of binding TNF-α wherein the heavy and light antibody chains comprise the sequences identified by SEQ ID NO: 263 and SEQ ID NO: 264, respectively.

Another preferred embodiment is an isolated antibody or antigen binding portion thereof capable of binding TNF-α wherein the $V_h$ and $V_l$ antibody chains comprise the sequences identified by SEQ ID NO: 271 and SEQ ID NO: 272, respectively.

Another preferred embodiment is an isolated antibody or antigen binding portion thereof capable of binding TNF-α wherein the heavy and light antibody chains comprise the sequences identified by SEQ ID NO: 269 and SEQ ID NO: 270, respectively.

Another preferred embodiment is an isolated antibody or antigen binding portion thereof capable of binding TNF-α wherein the $V_h$ and $V_l$ antibody chains comprise the sequences identified by SEQ ID NO: 291 and SEQ ID NO: 292, respectively.

Another preferred embodiment is an isolated antibody or antigen binding portion thereof capable of binding TNF-α wherein the heavy and light antibody chains comprise the sequences identified by SEQ ID NO: 289 and SEQ ID NO: 290, respectively.

Another preferred embodiment is an isolated antibody or antigen binding portion thereof capable of binding TNF-α wherein the $V_h$ and $V_l$ antibody chains comprise the sequences identified by SEQ ID NO: 295 and SEQ ID NO: 296, respectively.

Another preferred embodiment is an isolated antibody or antigen binding portion thereof capable of binding TNF-α wherein the heavy and light antibody chains comprise the sequences identified by SEQ ID NO: 293 and SEQ ID NO: 294, respectively.

Another preferred embodiment is an isolated antibody or antigen binding portion thereof capable of binding TNF-α wherein the $V_h$ and $V_l$ antibody chains comprise the sequences identified by SEQ ID NO: 303 and SEQ ID NO: 304, respectively.

Another preferred embodiment is an isolated antibody or antigen binding portion thereof capable of binding TNF-α wherein the heavy and light antibody chains comprise the sequences identified by SEQ ID NO: 301 and SEQ ID NO: 302, respectively.

Another preferred embodiment is an isolated antibody or antigen binding portion thereof capable of binding TNF-α wherein the $V_h$ and $V_l$ antibody chains comprise the sequences identified by SEQ ID NO: 309 and SEQ ID NO: 310, respectively.

Another preferred embodiment is an isolated antibody or antigen binding portion thereof capable of binding TNF-α wherein the heavy and light antibody chains comprise the sequences identified by SEQ ID NO: 307 and SEQ ID NO: 308, respectively.

Another preferred embodiment is an isolated antibody or antigen binding portion thereof capable of binding TNF-α wherein the $V_h$ and $V_l$ antibody chains comprise the sequences identified by SEQ ID NO: 313 and SEQ ID NO: 314, respectively.

Another preferred embodiment is an isolated antibody or antigen binding portion thereof capable of binding TNF-α wherein the heavy and light antibody chains comprise the sequences identified by SEQ ID NO: 311 and SEQ ID NO: 312, respectively.

Another preferred embodiment is an isolated antibody or antigen binding portion thereof capable of binding TNF-α wherein the $V_h$ and $V_l$ antibody chains comprise the sequences identified by SEQ ID NO: 321 and SEQ ID NO: 322, respectively.

Another preferred embodiment is an isolated antibody or antigen binding portion thereof capable of binding TNF-α wherein the heavy and light antibody chains comprise the sequences identified by SEQ ID NO: 319 and SEQ ID NO: 320, respectively.

Another preferred embodiment is an isolated antibody or antigen binding portion thereof capable of binding TNF-α wherein the $V_h$ and $V_l$ antibody chains comprise the sequences identified by SEQ ID NO: 359 and SEQ ID NO: 360, respectively.

Another preferred embodiment is an isolated antibody or antigen binding portion thereof capable of binding TNF-α wherein the heavy and light antibody chains comprise the sequences identified by SEQ ID NO: 357 and SEQ ID NO: 358, respectively.

Another preferred embodiment is an isolated antibody or antigen binding portion thereof capable of binding TNF-α wherein the $V_h$ and $V_l$ antibody chains comprise the sequences identified by SEQ ID NO: 375 and SEQ ID NO: 376, respectively.

Another preferred embodiment is an isolated antibody or antigen binding portion thereof capable of binding TNF-α wherein the heavy and light antibody chains comprise the sequences identified by SEQ ID NO: 373 and SEQ ID NO: 374, respectively.

Another preferred embodiment is an isolated antibody or antigen binding portion thereof capable of binding TNF-α wherein the $V_h$ and $V_l$ antibody chains comprise the sequences identified by SEQ ID NO: 401 and SEQ ID NO: 402, respectively.

Another preferred embodiment is an isolated antibody or antigen binding portion thereof capable of binding TNF-α wherein the heavy and light antibody chains comprise the sequences identified by SEQ ID NO: 399 and SEQ ID NO: 400, respectively.

Another preferred embodiment is an isolated antibody or antigen binding portion thereof capable of binding TNF-α wherein the $V_h$ and $V_l$ antibody chains comprise the sequences identified by SEQ ID NO: 453 and SEQ ID NO: 454, respectively.

Another preferred embodiment is an isolated antibody or antigen binding portion thereof capable of binding TNF-α wherein the heavy and light antibody chains comprise the sequences identified by SEQ ID NO: 451 and SEQ ID NO: 452, respectively.

Another preferred embodiment is an isolated antibody or antigen binding portion thereof capable of binding TNF-α wherein a heavy chain comprises the sequences which are comprised in a group of sequences consisting of SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 65, SEQ ID NO: 66, SEQ ID NO: 67, SEQ ID NO: 68, SEQ ID NO: 69, SEQ ID NO: 70, SEQ ID NO: 72, SEQ ID NO: 74, SEQ ID NO: 78, SEQ ID NO: 79, SEQ ID NO: 103, SEQ ID NO: 106, SEQ ID NO: 112, SEQ ID NO: 139, SEQ ID NO: 141, SEQ ID NO: 143, SEQ ID NO: 145, SEQ ID NO: 147, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 210, SEQ ID NO: 214, SEQ ID NO: 215, SEQ ID NO: 216, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257, SEQ ID NO: 259, SEQ ID NO: 261, SEQ ID NO: 263, SEQ ID NO: 267, SEQ ID NO: 269, SEQ ID NO: 273, SEQ ID NO: 275, SEQ ID NO: 277, SEQ ID NO: 279, SEQ ID NO: 281, SEQ ID NO: 283, SEQ ID NO: 285, SEQ ID NO: 287, SEQ ID NO: 289, SEQ ID NO: 293, SEQ ID NO: 297, SEQ ID NO: 299, SEQ ID NO: 301, SEQ ID NO: 305, SEQ ID NO: 307, SEQ ID NO: 311, SEQ ID NO: 315, SEQ ID NO: 317, SEQ ID NO: 319, SEQ ID NO: 323, SEQ ID NO: 325, SEQ ID NO: 327, SEQ ID NO: 329, SEQ ID NO: 331, SEQ ID NO: 333, SEQ ID NO: 335, SEQ ID NO: 337, SEQ ID NO: 339, SEQ ID NO: 341, SEQ ID NO: 343, SEQ ID NO: 345, SEQ ID NO: 347, SEQ ID NO: 351, SEQ ID NO: 353, SEQ ID NO: 355, SEQ ID NO: 357, SEQ ID NO: 361, SEQ ID NO: 363, SEQ ID NO: 365, SEQ ID NO: 367, SEQ ID NO: 369, SEQ ID NO: 371, SEQ ID NO: 373, SEQ ID NO: 375, SEQ ID NO: 377, SEQ ID NO: 379, SEQ ID NO: 381, SEQ ID NO: 383, SEQ ID NO: 385, SEQ ID NO: 387, SEQ ID NO: 389, SEQ ID NO: 391, SEQ ID NO: 393, SEQ ID NO: 395, SEQ ID NO: 397, SEQ ID NO: 399, SEQ ID NO: 403, SEQ ID NO: 405, SEQ ID NO: 407, SEQ ID NO: 409, SEQ ID NO: 411, SEQ ID NO: 413, SEQ ID NO: 415, SEQ ID NO: 417, SEQ ID NO: 419, SEQ ID NO: 421, SEQ ID NO: 423, SEQ ID NO: 425, SEQ ID NO: 427, SEQ ID NO: 429, SEQ ID NO: 431, SEQ ID NO: 433, SEQ ID NO: 435, SEQ ID NO: 437, SEQ ID NO: 441, SEQ ID NO: 443, SEQ ID NO: 445, SEQ ID NO: 447, SEQ ID NO: 449, SEQ ID NO: 451, SEQ ID NO: 457, SEQ ID NO: 459, and SEQ ID NO: 461.

Another preferred embodiment is an isolated antibody or antigen binding portion thereof capable of binding TNF-α wherein a light chain comprises the sequence which is comprised in a group of sequences consisting of SEQ ID NO: 64, SEQ ID NO: 71, SEQ ID NO: 73, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 104, SEQ ID NO: 105, SEQ ID NO: 107, SEQ ID NO: 108, SEQ ID NO: 109, SEQ ID NO: 110, SEQ ID NO: 111, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 211, SEQ ID NO: 212, SEQ ID NO: 213, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286, SEQ ID NO: 288, SEQ ID NO: 290, SEQ ID NO: 292, SEQ ID NO: 294, SEQ ID NO: 296, SEQ ID NO: 298, SEQ ID NO: 300, SEQ ID NO: 302, SEQ ID NO: 304, SEQ ID NO: 306, SEQ ID NO: 308, SEQ ID NO: 310, SEQ ID NO: 312, SEQ ID NO: 314, SEQ ID NO: 316, SEQ ID NO: 318, SEQ ID NO: 320, SEQ ID NO: 322, SEQ ID NO: 324, SEQ ID NO: 326, SEQ ID NO: 328, SEQ ID NO: 330, SEQ ID NO: 332, SEQ ID NO: 334, SEQ ID NO: 336, SEQ ID NO: 338, SEQ ID NO: 340, SEQ ID NO: 342, SEQ ID NO: 344, SEQ ID NO: 346, SEQ ID NO: 348, SEQ ID NO: 350, SEQ ID NO: 352, SEQ ID NO: 354, SEQ ID NO: 356, SEQ ID NO: 358, SEQ ID NO: 360, SEQ ID NO: 362, SEQ ID NO: 364, SEQ ID NO: 366, SEQ ID NO: 368, SEQ ID NO: 370, SEQ ID NO: 372, SEQ ID NO: 374, SEQ ID NO: 376, SEQ ID NO: 378, SEQ ID NO: 380, SEQ ID NO: 382, SEQ ID NO: 384, SEQ ID NO: 386, SEQ ID NO: 388, SEQ ID NO: 390, SEQ ID NO: 392, SEQ ID NO: 394, SEQ ID NO: 396, SEQ ID NO: 398, SEQ ID NO: 400, SEQ ID NO: 404, SEQ ID NO: 406, SEQ ID NO: 408, SEQ ID NO: 410, SEQ ID NO: 412, SEQ ID NO: 414, SEQ ID NO: 416, SEQ ID NO: 418, SEQ ID NO: 420, SEQ ID NO: 422, SEQ ID NO: 424, SEQ ID NO: 426, SEQ ID NO: 428, SEQ ID NO: 430, SEQ ID NO: 432, SEQ ID NO: 434, SEQ ID NO: 436, SEQ ID NO: 438, SEQ ID NO: 440, SEQ ID NO: 442, SEQ ID NO: 444, SEQ ID NO: 446, SEQ ID NO: 448, SEQ ID NO: 450, SEQ ID NO: 452, SEQ ID NO: 454, SEQ ID NO: 458, and SEQ ID NO: 460.

Another preferred embodiment is an isolated antibody or antigen binding portion thereof capable of binding TNF-α wherein the heavy chain comprises the sequence which are comprised in a group of sequences consisting of SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 65, SEQ ID NO: 66, SEQ ID NO: 67, SEQ ID NO: 68, SEQ ID NO: 69, SEQ ID NO: 70, SEQ ID NO: 72, SEQ ID NO: 74, SEQ ID NO: 78, SEQ ID NO: 79, SEQ ID NO: 103, SEQ ID NO: 106, SEQ ID NO: 112, SEQ ID NO: 139, SEQ ID NO: 141, SEQ ID NO: 143, SEQ ID NO: 145, SEQ ID NO: 147, SEQ ID NO: 151, SEQ ID NO: 153, SEQ ID NO: 155, SEQ ID NO: 157, SEQ ID NO: 159, SEQ ID NO: 161, SEQ ID NO: 163, SEQ ID NO: 165, SEQ ID NO: 167, SEQ ID NO: 169, SEQ ID NO: 171, SEQ ID NO: 173, SEQ ID NO: 175, SEQ ID NO: 177, SEQ ID NO: 179, SEQ ID NO: 181, SEQ ID NO: 183, SEQ ID NO: 185, SEQ ID NO: 187, SEQ ID NO: 189, SEQ ID NO: 191, SEQ ID NO: 193, SEQ ID NO: 195, SEQ ID NO: 197, SEQ ID NO: 199, SEQ ID NO: 201, SEQ ID NO: 210, SEQ ID NO: 214, SEQ ID NO: 215, SEQ ID NO: 216, SEQ ID NO: 217, SEQ ID NO: 219, SEQ ID NO: 221, SEQ ID NO: 223, SEQ ID NO: 225, SEQ ID NO: 227, SEQ ID NO: 229, SEQ ID NO: 231, SEQ ID NO: 233, SEQ ID NO: 235, SEQ ID NO: 237, SEQ ID NO: 239, SEQ ID NO: 241, SEQ ID NO: 243, SEQ ID NO: 245, SEQ ID NO: 247, SEQ ID NO: 249, SEQ ID NO: 251, SEQ ID NO: 253, SEQ ID NO: 255, SEQ ID NO: 257, SEQ ID NO: 259, SEQ ID NO: 261, SEQ ID NO: 263, SEQ ID NO: 267, SEQ ID NO: 269, SEQ ID NO: 273, SEQ ID NO: 275, SEQ ID NO: 277, SEQ ID NO: 279, SEQ ID NO: 281, SEQ ID NO: 283, SEQ ID NO: 285, SEQ ID NO: 287, SEQ ID NO: 289, SEQ ID NO: 293, SEQ ID NO: 297, SEQ ID NO: 299, SEQ ID NO: 301, SEQ ID NO: 305, SEQ ID NO: 307, SEQ ID NO: 311, SEQ ID NO: 315, SEQ ID NO: 317, SEQ ID NO: 319, SEQ ID NO: 323, SEQ ID NO: 325, SEQ ID NO: 327, SEQ ID NO: 329, SEQ ID NO: 331, SEQ ID NO: 333, SEQ ID NO: 335, SEQ ID NO: 337, SEQ ID NO: 339, SEQ ID NO: 341, SEQ ID NO: 343, SEQ ID NO: 345, SEQ ID NO: 347, SEQ ID NO: 351, SEQ ID NO: 353, SEQ ID NO: 355, SEQ ID NO: 357, SEQ ID NO: 361, SEQ ID NO: 363, SEQ ID NO: 365, SEQ ID NO: 367, SEQ ID NO: 369, SEQ ID NO: 371, SEQ ID NO: 373, SEQ ID NO: 375, SEQ ID NO: 377, SEQ ID NO: 379, SEQ ID NO: 381, SEQ ID NO: 383, SEQ ID NO: 385, SEQ ID NO: 387, SEQ ID NO: 389, SEQ ID NO: 391, SEQ ID NO: 393, SEQ ID NO: 395, SEQ ID NO: 397, SEQ ID NO: 399, SEQ ID NO: 403, SEQ ID NO: 405, SEQ ID NO: 407, SEQ ID NO: 409, SEQ ID NO: 411, SEQ ID NO: 413, SEQ ID NO: 415, SEQ ID NO: 417, SEQ ID NO: 419, SEQ ID NO: 421, SEQ ID NO: 423, SEQ ID NO: 425, SEQ ID NO: 427, SEQ ID NO: 429, SEQ ID NO: 431, SEQ ID NO: 433, SEQ ID NO: 435, SEQ ID NO: 437, SEQ ID NO: 441, SEQ ID NO: 443, SEQ ID NO: 445, SEQ ID NO: 447, SEQ ID NO: 449, SEQ ID NO: 451, SEQ ID NO: 457, SEQ ID NO: 459, and SEQ ID NO: 461 and wherein a light chain comprises a sequence which is comprised in a group of sequences consisting of SEQ ID NO: 64, SEQ ID NO: 71, SEQ ID NO: 73, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 94, SEQ LID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 104, SEQ ID NO: 105, SEQ ID NO: 107, SEQ ID NO: 108, SEQ ID NO: 109, SEQ ID NO: 110, SEQ ID NO: 111, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, SEQ ID NO: 131, SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 140, SEQ ID NO: 142, SEQ ID NO: 144, SEQ ID NO: 146, SEQ ID NO: 148, SEQ ID NO: 150, SEQ ID NO: 152, SEQ ID NO: 154, SEQ ID NO: 156, SEQ ID NO: 158, SEQ ID NO: 160, SEQ ID NO: 162, SEQ ID NO: 164, SEQ ID NO: 166, SEQ ID NO: 168, SEQ ID NO: 170, SEQ ID NO: 172, SEQ ID NO: 174, SEQ ID NO: 176, SEQ ID NO: 178, SEQ ID NO: 180, SEQ ID NO: 182, SEQ ID NO: 184, SEQ ID NO: 186, SEQ ID NO: 188, SEQ ID NO: 190, SEQ ID NO: 192, SEQ ID NO: 194, SEQ ID NO: 196, SEQ ID NO: 198, SEQ ID NO: 200, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 211, SEQ ID NO: 212, SEQ ID NO: 213, SEQ ID NO: 218, SEQ ID NO: 220, SEQ ID NO: 222, SEQ ID NO: 224, SEQ ID NO: 226, SEQ ID NO: 228, SEQ ID NO: 230, SEQ ID NO: 232, SEQ ID NO: 234, SEQ ID NO: 236, SEQ ID NO: 238, SEQ ID NO: 240, SEQ ID NO: 242, SEQ ID NO: 244, SEQ ID NO: 246, SEQ ID NO: 248, SEQ ID NO: 250, SEQ ID NO: 252, SEQ ID NO: 254, SEQ ID NO: 256, SEQ ID NO: 258, SEQ ID NO: 260, SEQ ID NO: 262, SEQ ID NO: 264, SEQ ID NO: 266, SEQ ID NO: 268, SEQ ID NO: 270, SEQ ID NO: 272, SEQ ID NO: 274, SEQ ID NO: 276, SEQ ID NO: 278, SEQ ID NO: 280, SEQ ID NO: 282, SEQ ID NO: 284, SEQ ID NO: 286, SEQ ID NO: 288, SEQ ID NO: 290, SEQ ID NO: 292, SEQ ID NO: 294, SEQ ID NO: 296, SEQ ID NO: 298, SEQ ID NO: 300, SEQ ID NO: 302, SEQ ID NO: 304, SEQ ID NO: 306, SEQ ID NO: 308, SEQ ID NO: 310, SEQ ID NO: 312, SEQ ID NO: 314, SEQ ID NO: 316, SEQ ID NO: 318, SEQ ID NO: 320, SEQ ID NO: 322, SEQ ID NO: 324, SEQ ID NO: 326, SEQ ID NO: 328, SEQ ID NO: 330, SEQ ID NO: 332, SEQ ID NO: 334, SEQ ID NO: 336, SEQ ID NO: 338, SEQ ID NO: 340, SEQ ID NO: 342, SEQ ID NO: 344, SEQ ID NO: 346, SEQ ID NO: 348, SEQ ID NO: 350, SEQ ID NO: 352, SEQ ID NO: 354, SEQ ID NO: 356, SEQ ID NO: 358, SEQ ID NO: 360, SEQ ID NO: 362, SEQ ID NO: 364, SEQ ID NO: 366, SEQ ID NO: 368, SEQ ID NO: 370, SEQ ID NO: 372, SEQ ID NO: 374, SEQ ID NO: 376, SEQ ID NO: 378, SEQ ID NO: 380, SEQ ID NO: 382, SEQ ID NO: 384, SEQ ID NO: 386, SEQ ID NO: 388, SEQ ID NO: 390, SEQ ID NO: 392, SEQ ID NO: 394, SEQ ID NO: 396, SEQ ID NO: 398, SEQ ID NO: 400, SEQ ID NO: 404, SEQ ID NO: 406, SEQ ID NO: 408, SEQ ID NO: 410, SEQ ID NO: 412, SEQ ID NO: 414, SEQ ID NO: 416, SEQ ID NO: 418, SEQ ID NO: 420, SEQ ID NO: 422, SEQ ID NO: 424, SEQ ID NO: 426, SEQ ID NO: 428, SEQ ID NO: 430, SEQ ID NO: 432, SEQ ID NO: 434, SEQ ID NO: 436, SEQ ID NO: 438, SEQ ID NO: 440, SEQ ID NO: 442, SEQ ID NO: 444, SEQ ID NO: 446, SEQ ID NO: 448, SEQ ID NO: 450, SEQ ID NO: 452, SEQ ID NO: 454, SEQ ID NO: 458, SEQ ID NO: 460, SEQ ID NO: 462. The preferred combinations are illustrated in table 2, where the binders are listed according their nomenclature used in the figures. In cases were no heavy chain or light chain is listed, the respective heavy or light chain from D2E7 (SEQ ID NO: 1 or 2, respectively) is used.

A further preferred embodiment is an aforementioned isolated antibody or antigen binding portion thereof capable of binding TNF-α with an affinity constant $K_D$ or $k_{off}$ rate constant that is a least 3 fold lower, preferably 5 fold lower, more preferably 10 fold lower than that of the antibody having a heavy chain and a light chain identified by SEQ ID NO: 463 and SEQ ID NO: 464, respectively. A further preferred embodiment is an aforementioned isolated antibody or antigen binding portion thereof capable of binding TNF-α with an affinity constant $K_D$ of less than 30 pM, more preferably of less or equal than 10 pM.

A further embodiment is an aforementioned isolated antibody or antigen binding portion thereof capable of binding TNF-α of mammalian origin, preferably from a mammal selected from the group consisting of primate, mouse, rat and pig. A more preferred embodiment is an aforementioned isolated antibody or antigen binding portions thereof capable of binding TNF-α of primate origin, preferably from a primate selected from the group consisting of human, baboon, marmoset, chimpanzee, cynomolgus and rhesus. Another more preferred embodiment is an aforementioned isolated antibody or antigen binding portions thereof capable of binding human TNF-α. A further preferred embodiment is an aforementioned isolated antibody or antigen binding portions thereof capable of specifically binding human TNF-α.

A more preferred embodiment is an aforementioned isolated antibody or antigen binding portions thereof capable of neutralizing TNF-α.

In another embodiment the aforementioned isolated antibodies or antigen binding portions thereof capable of binding TNF-α is an at least bi-specific antibody or fragment thereof, wherein at least one $V_h$ CDR1-3, $V_l$ CDR1-3, $V_h$, $V_l$ heavy or light chain comprises at least one of the aforementioned $V_h$ CDR1-3, $V_l$ CDR1-3, $V_h$, $V_l$ heavy or light chain of the invention.

Another embodiment is a nucleic acid encoding the aforementioned isolated antibodies or antigen binding portions thereof capable of binding TNF-α. A further embodiment is a vector comprising the aforementioned nucleic acid. Yet a further embodiment is a host cell comprising the aforementioned nucleic acid.

Another embodiment is a method of production of the aforementioned isolated antibodies or antigen binding portions thereof capable of binding TNF-α said method comprising culturing of a host cell of claim 14 under conditions allowing the expression of the antibody or binding portion thereof and recovering the antibody or binding portion thereof from the culture.

Another embodiment is a pharmaceutical composition comprising the aforementioned antibodies or antigen binding portions thereof and a pharmaceutically acceptable carrier. A further embodiment is the aforementioned pharmaceutical composition which further comprises at least one additional therapeutic agent.

Figure 3B:
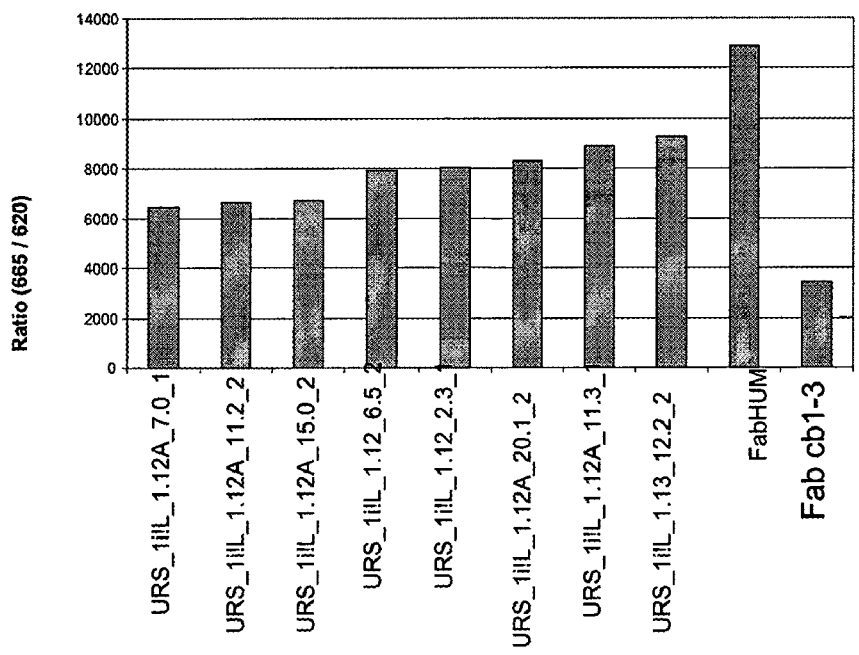
Figure 3C:
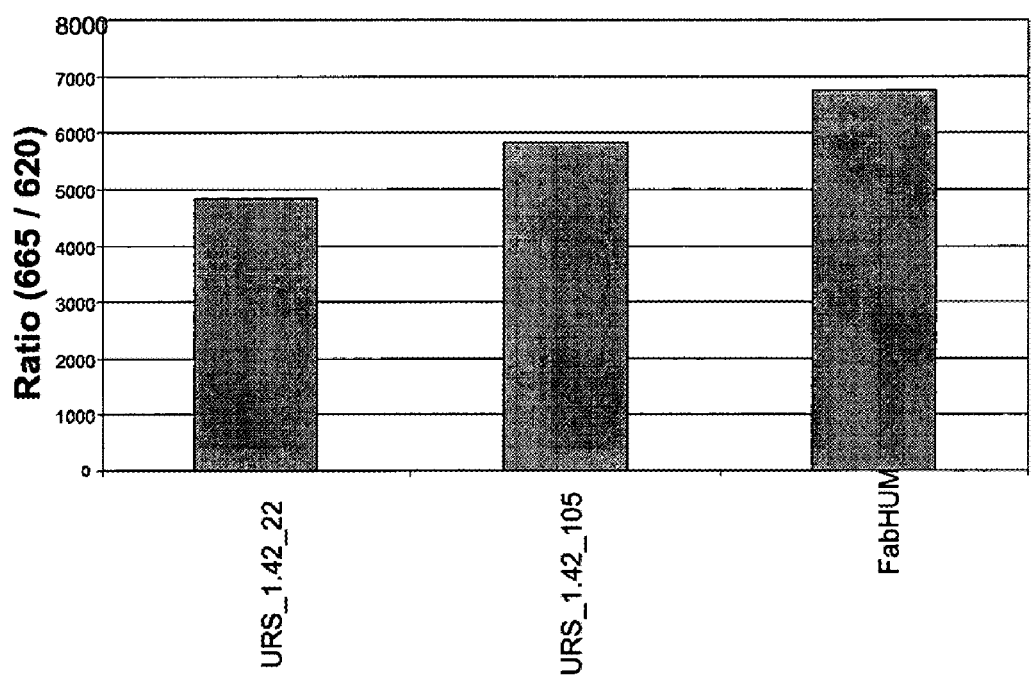

FIG. 2 shows a table of variant heavy and light chains. The alterations in amino acid sequence compared to the base sequence (wild type) is shown in bold letters. The "amino acid number" refers to the position of the amino acid according to the numbering provided in SEQ ID NO. 1. FIG. 3A-3C shows the results of a homogenous time-resolved energy transfer assay (HTRF®) comparing the variants of FIG. 2 to a Fab comprising the base heavy and light chain (SEQ ID NOs. 1 and 2, respectively) FabHUM. Lower 665/620 ratios indicate improved affinity; therefore, as shown in the charts, all of the variants of FIG. 2 had at least as strong of an affinity to TNFα as the positive control, FabHUM.

Figures 4, 5A:
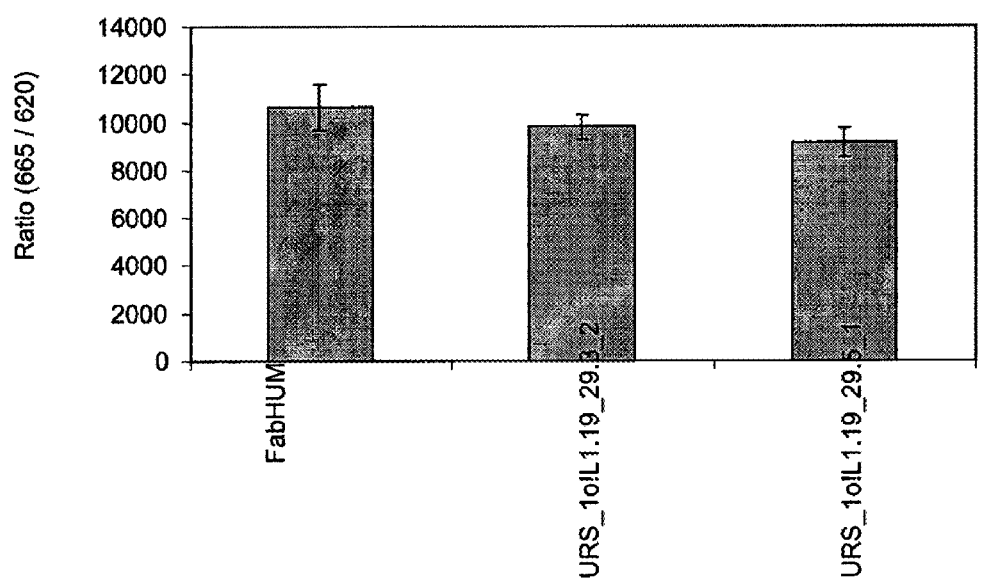

FIG. 4 shows a table of variant heavy chains having variations in CDR2 compared to the base sequence. The alterations in amino acid sequence compared to the base sequence (wild type) is shown in bold letters. The "amino acid number" refers to the position of the amino acid according to the numbering provided in SEQ ID NO. 1. FIG. 5A-5B shows the results of HTRF® comparing the variants of FIG. 4 to FabHUM. As shown in the charts, all of the variants of FIG. 4 had at least as strong of an affinity to TNFα as the positive control, FabHUM.

Figure 7A:
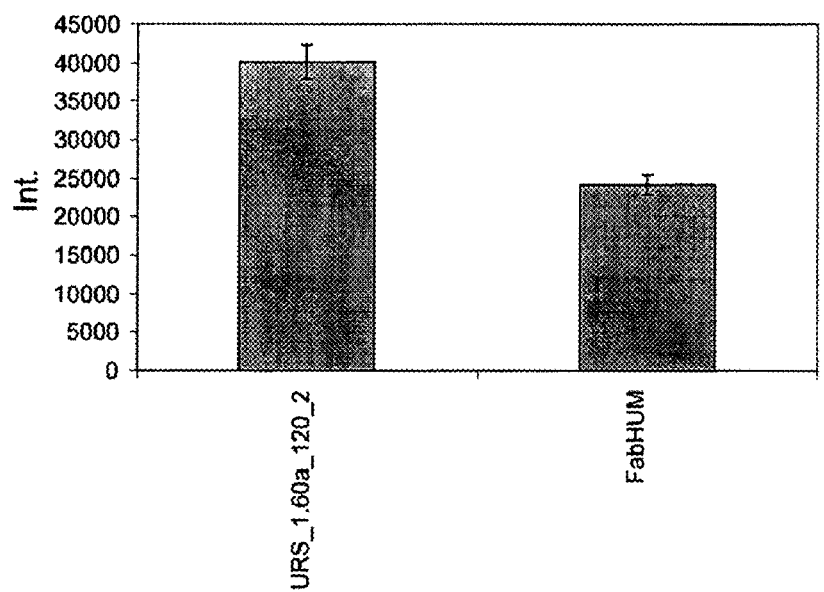
FIG. 7A is a chart showing data from an ELISA using Fab comprising the indicated variant from FIG. 6 compared to FabHUM.
Figure 7B:
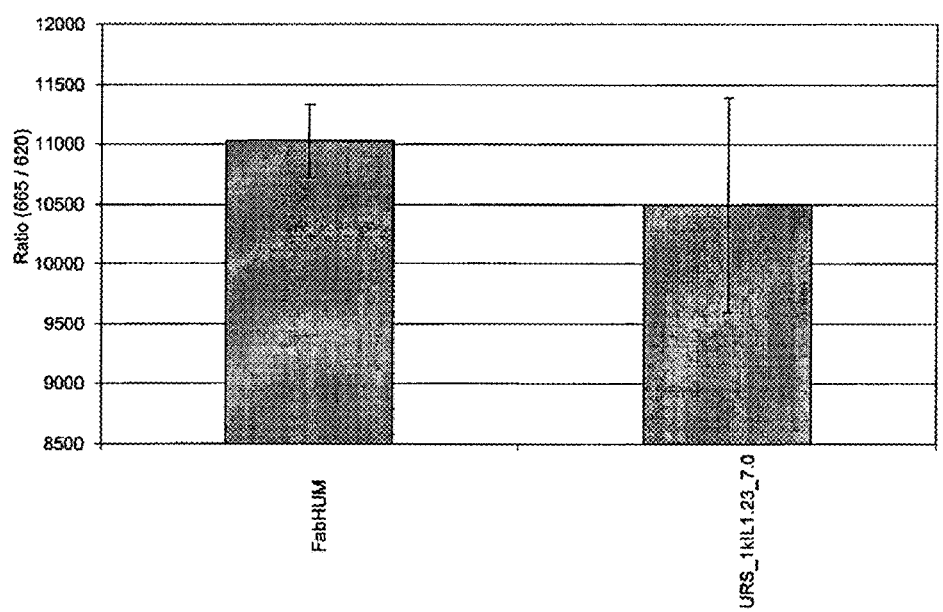
FIG. 7B is a chart showing data from a homogenous time-resolved energy transfer assay using Fab comprising the indicated variants from FIG. 6 compared to FabHUM.
Figure 9B:
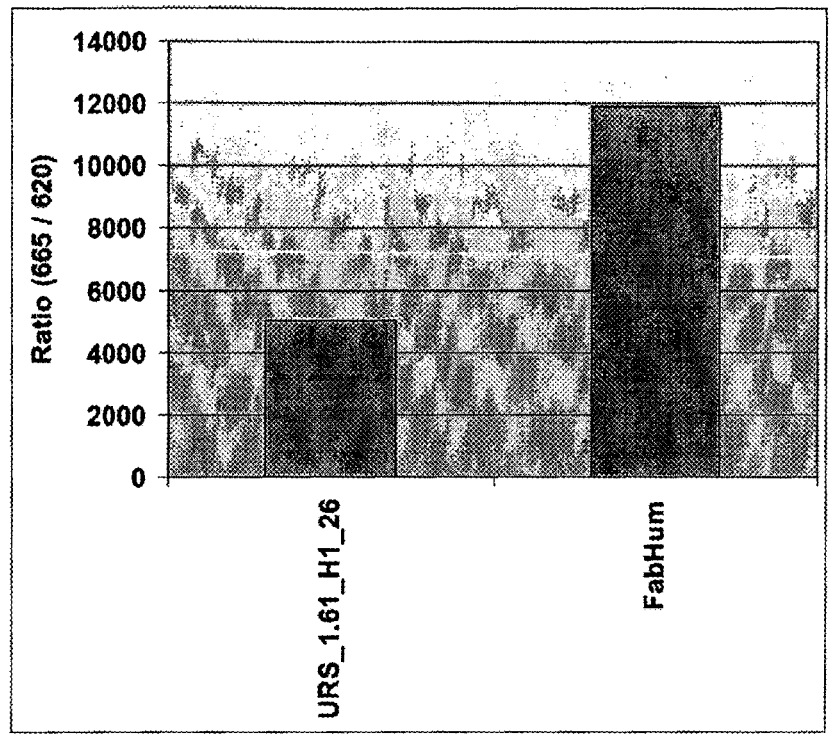
Figure 9C:
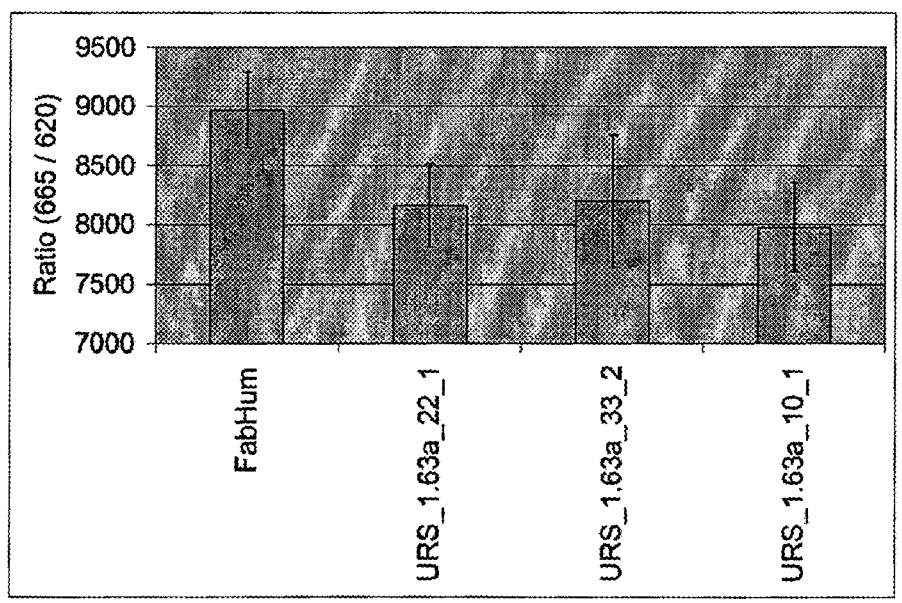
Figure 9D:
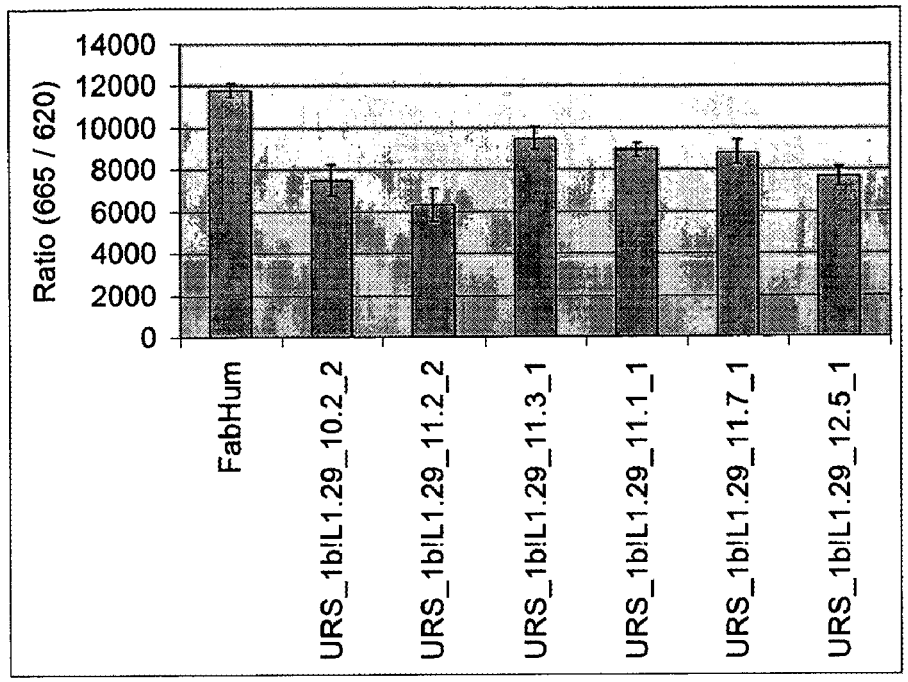
Figure 9E:
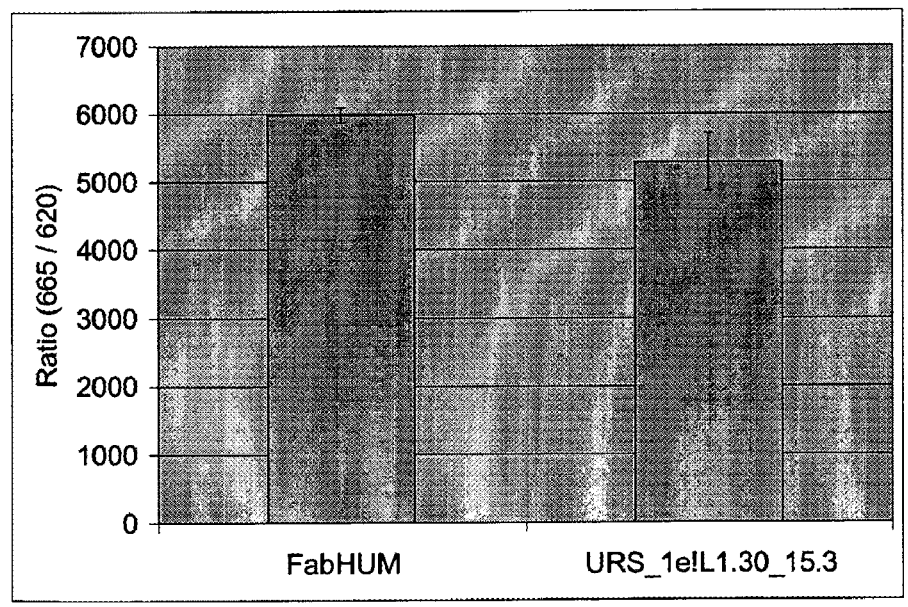
Figure 9F:
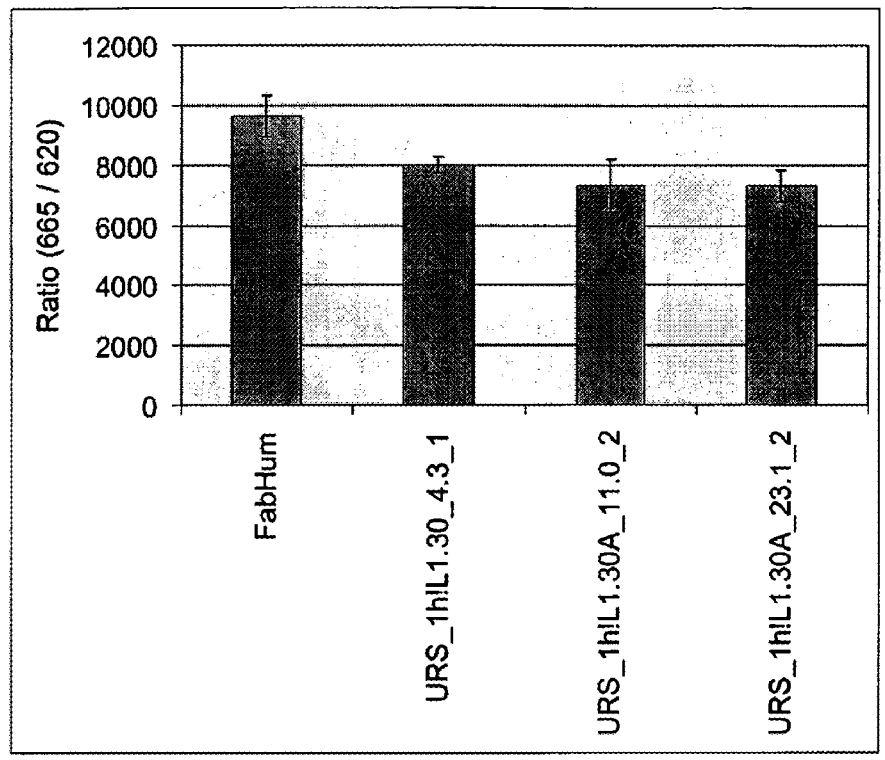
Figure 9G:
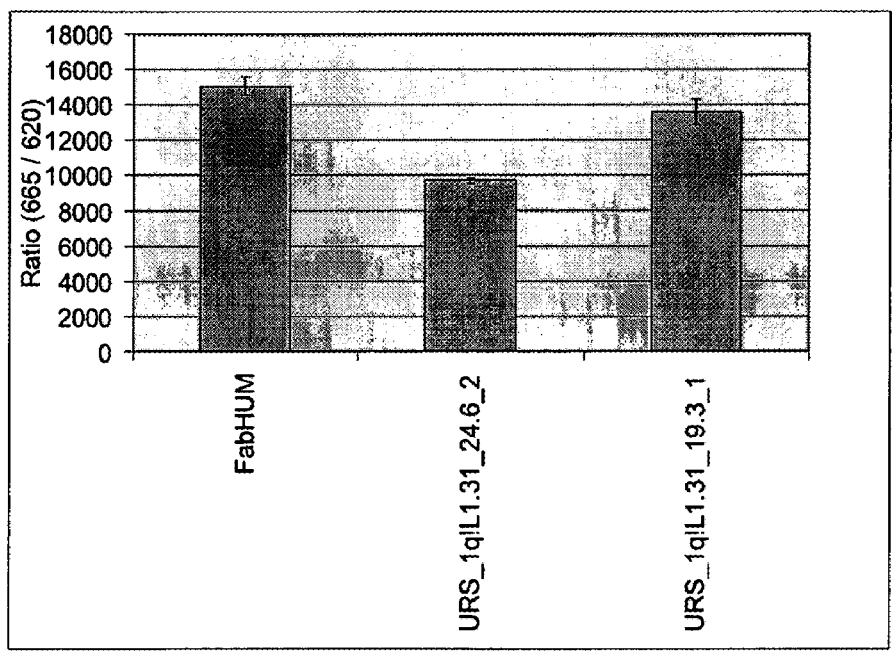
Figure 11B:
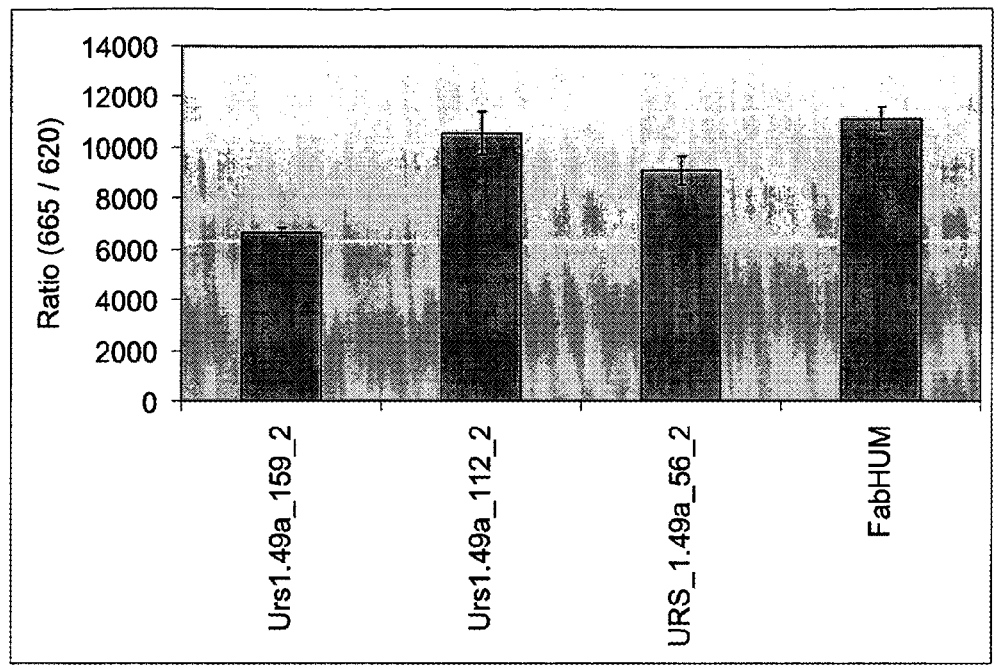
Figure 11C:
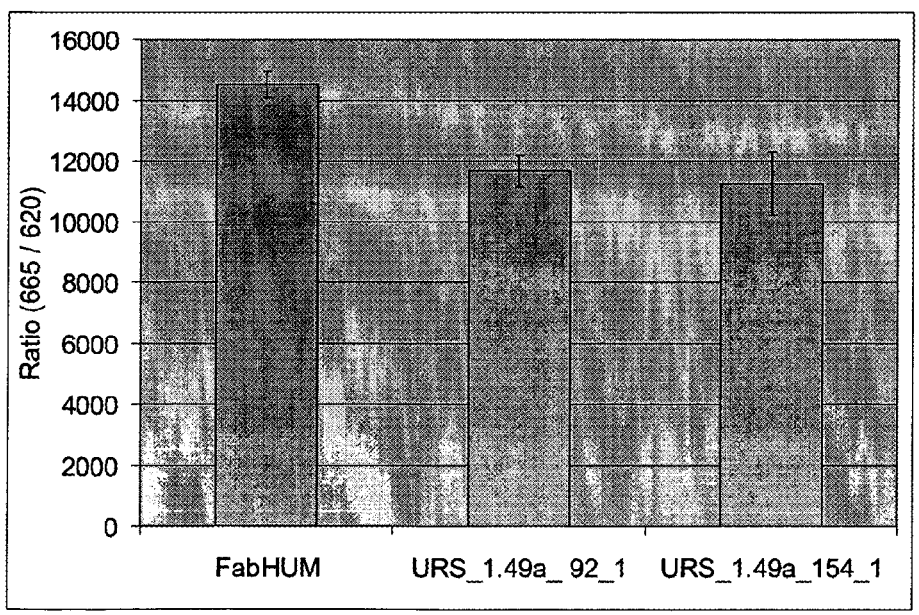
Figure 11D:
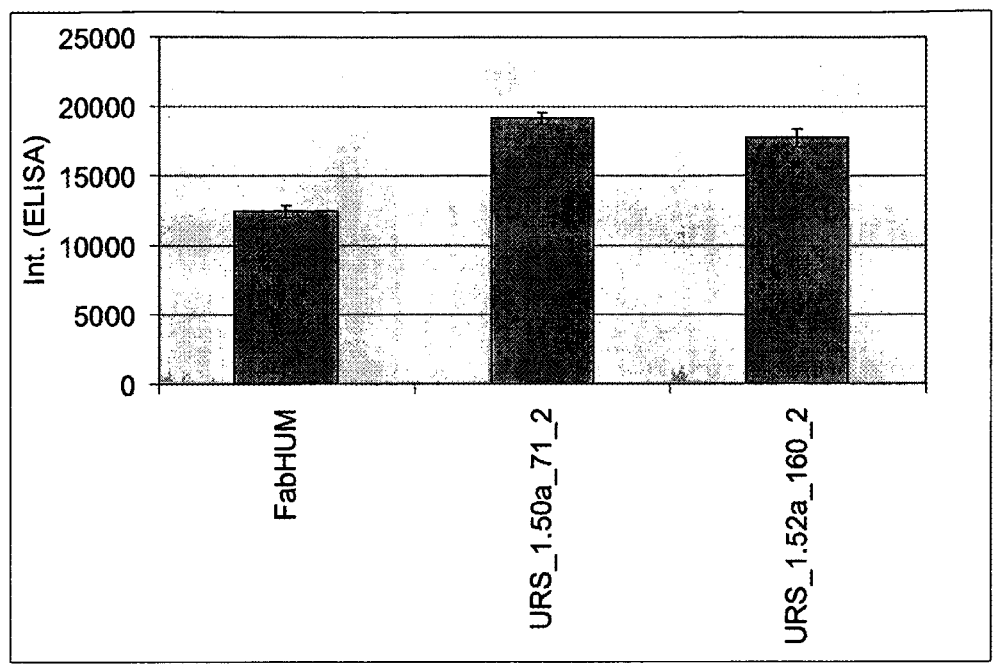
Figure 11E:
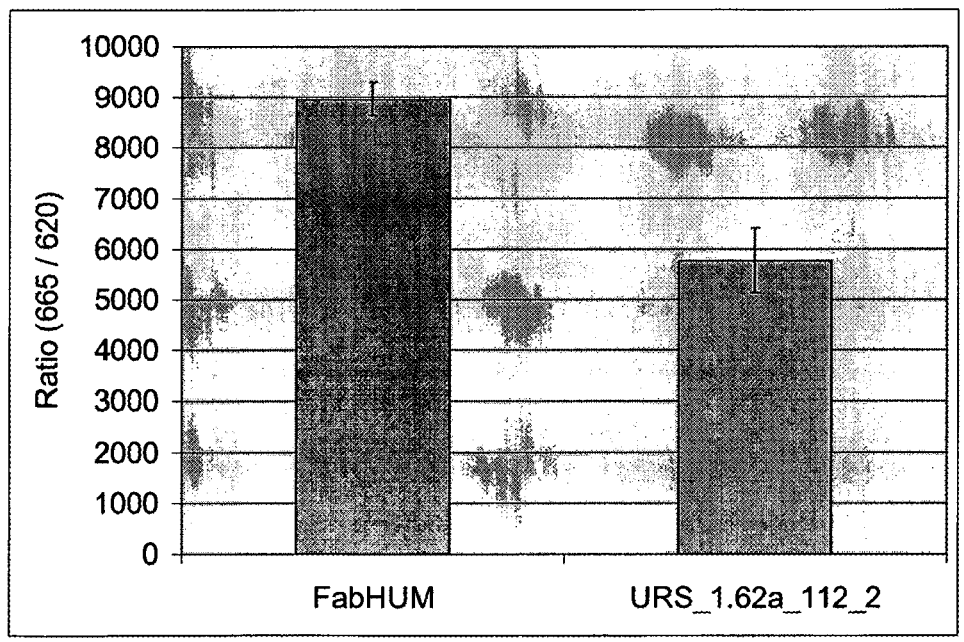
Figure 11F:
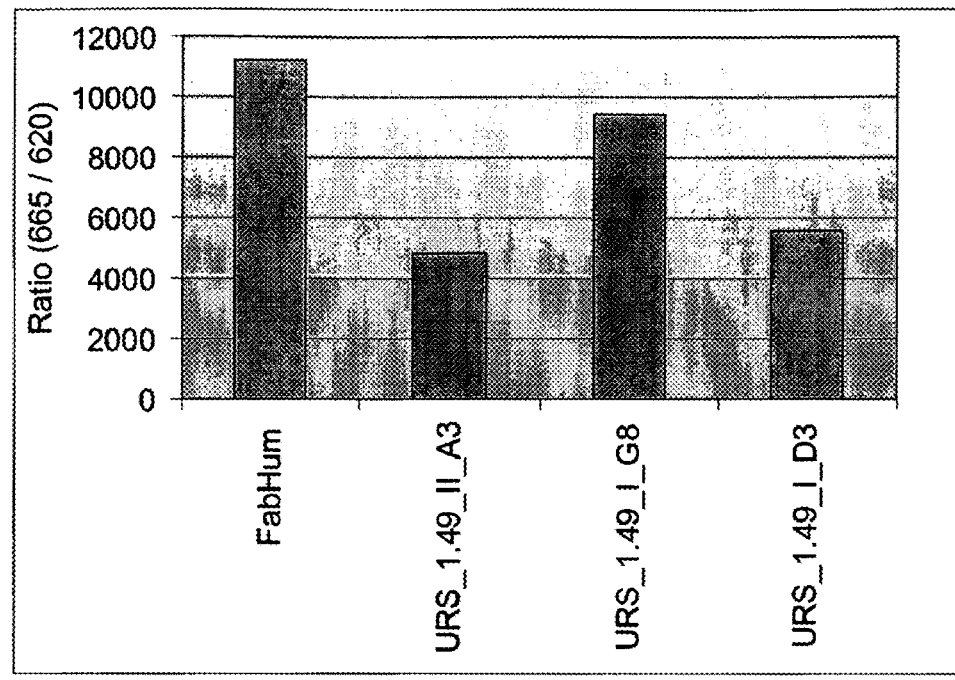
Figure 11G:
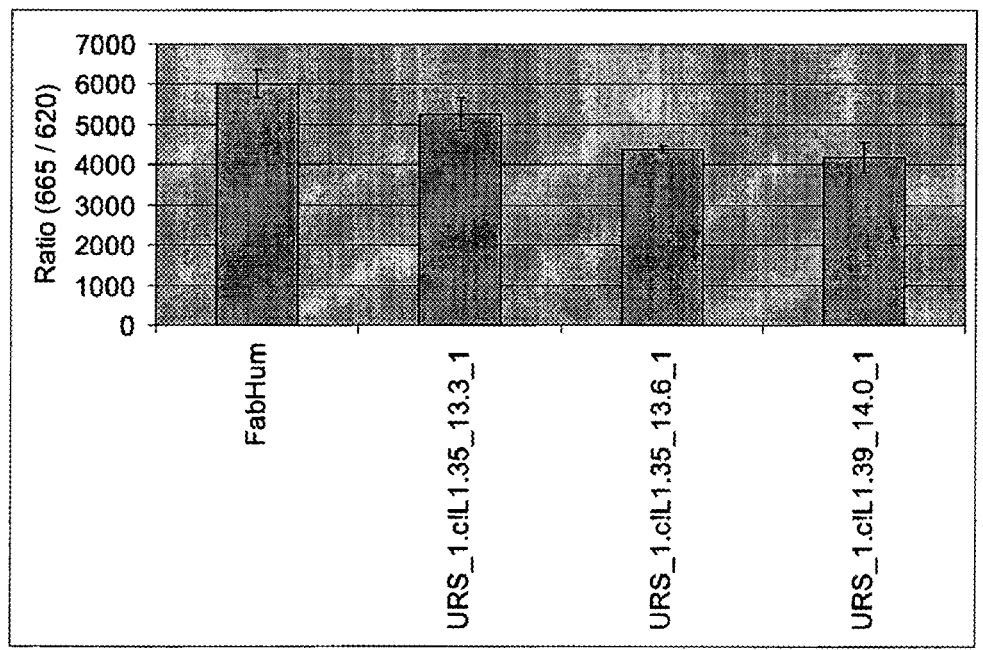
Figure 11H:
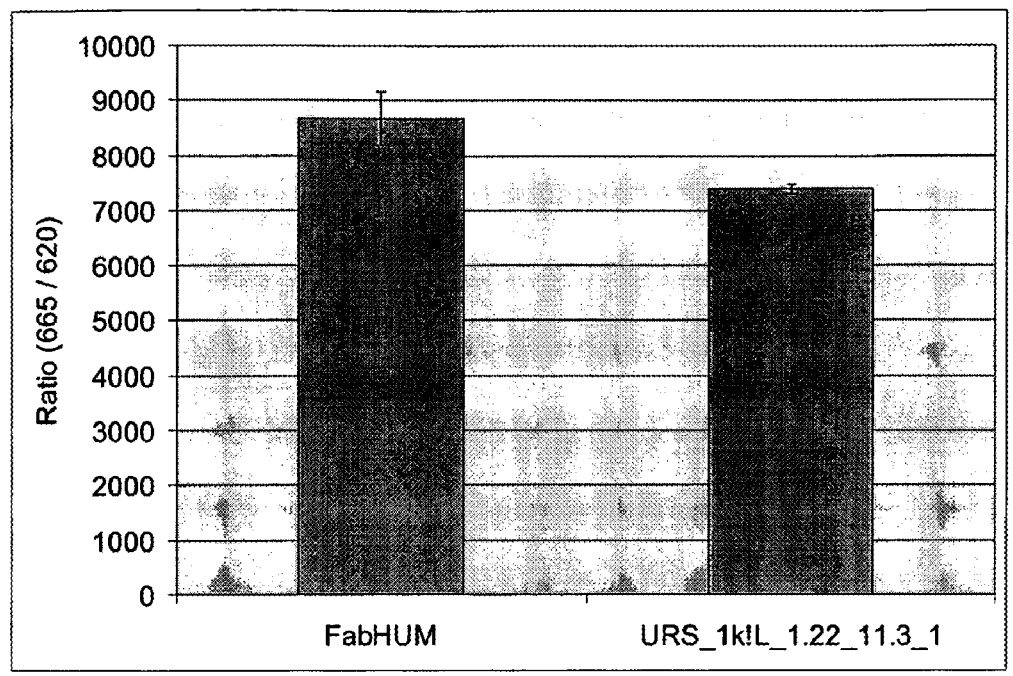
Figure 11I:
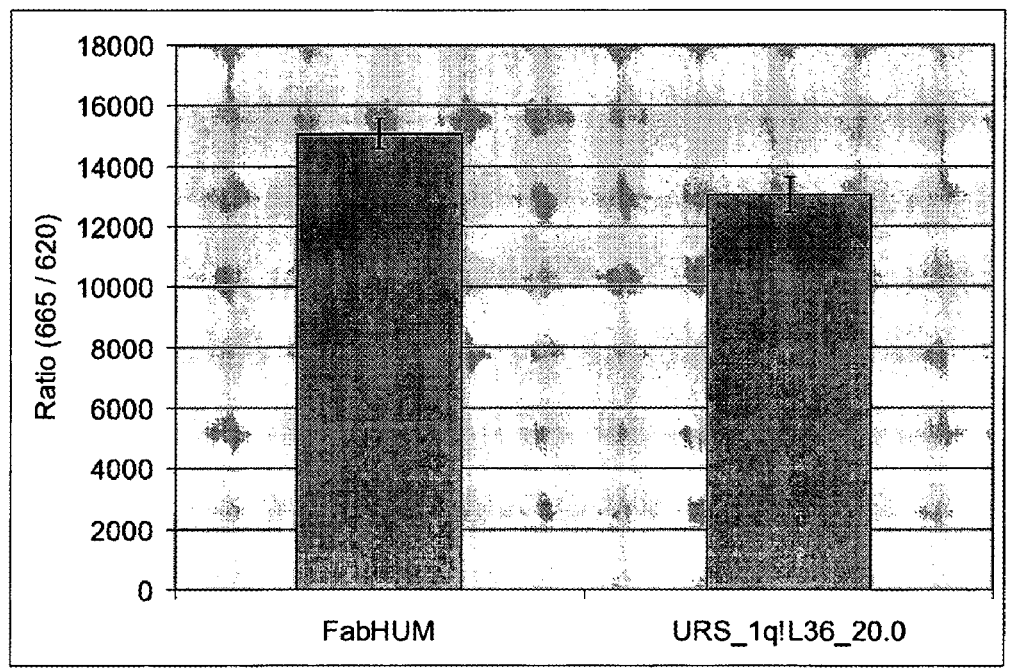

FIG. 7 shows a table of variant heavy chains having variations in CDR3 compared to the base sequence. The alterations in amino acid sequence compared to the base sequence (wild type) is shown in bold letters. The "amino acid number" refers to the position of the amino acid according to the numbering provided in SEQ ID NO. 1. FIG. 8A shows the results of an ELISA assay using the indicated variant. FIG. 8B shows the results of HTRF® comparing the variants of FIG. 6 to FabHUM. As shown in the charts, the variants of FIG. 7 had a comparable affinity to TNFα as the positive control, FabHUM.

FIG. 8 shows a table of variant light chains having variations in CDR1 sequence compared to the base sequence. The alterations in amino acid sequence compared to the base sequence (wild type) is shown in bold letters. The "amino acid number" refers to the position of the amino acid according to the numbering provided in SEQ ID NO. 2. FIG. 9A-9G show the results of HTRF® comparing the variants of FIG. 8 to FabHUM. As shown in the charts, many of the variants of FIG. 8 had at least as strong of an affinity to TNFα as the positive control, FabHUM.

FIG. 10 shows a table of variant light chains having the indicated variations in sequence and heavy chains having the indicated variations in sequence compared to the base sequence. The alterations in amino acid sequence compared to the base sequence (wild type) is shown in bold letters. The "amino acid number" refers to the position of the amino acid according to the numbering provided in SEQ ID NO. 2 or 1, respectively. FIG. 11A-11I shows the results of HTRF® comparing the variants of FIG. 10 to FabHUM. As shown in the charts, many of the variants of FIG. 10 had at least as strong of an affinity to TNFα as the positive control, FabHUM.

Figures 12, 13A:
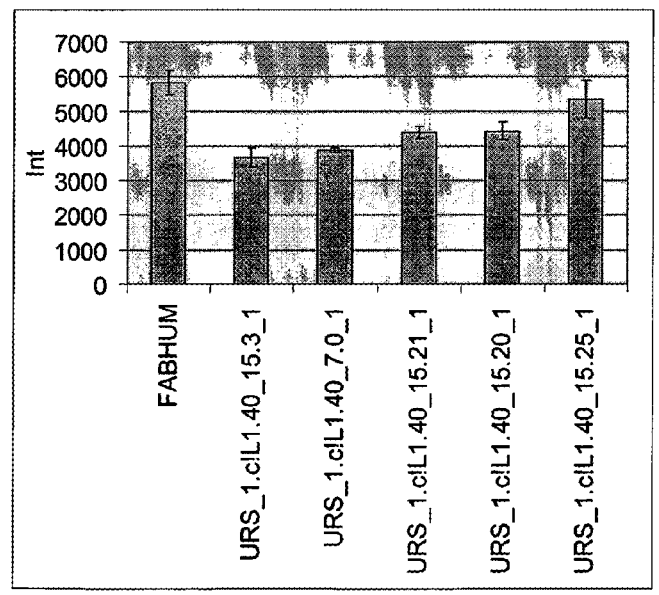
FIG. 12 is a Table showing light chain variants provided herein having the indicated altered residues in CDR-3 and other altered residues compared to the corresponding base sequence (wild type).
FIG. 13A-13D are charts showing data from a homogenous time-resolved energy transfer assay using Fab comprising the indicated variants from FIG. 12 compared to FabHUM or FabA1.
Figure 13B:
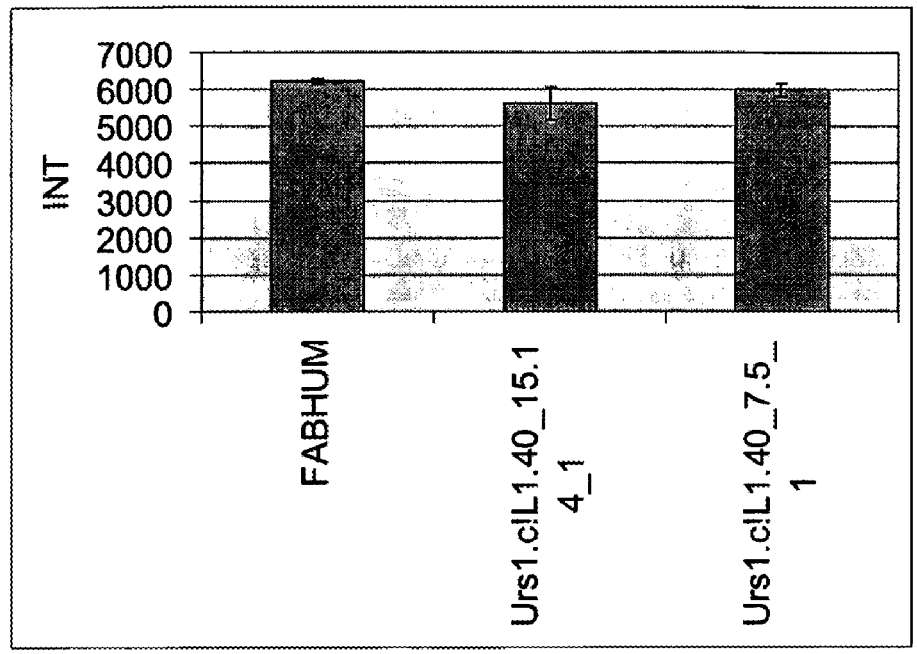
Figure 13C:
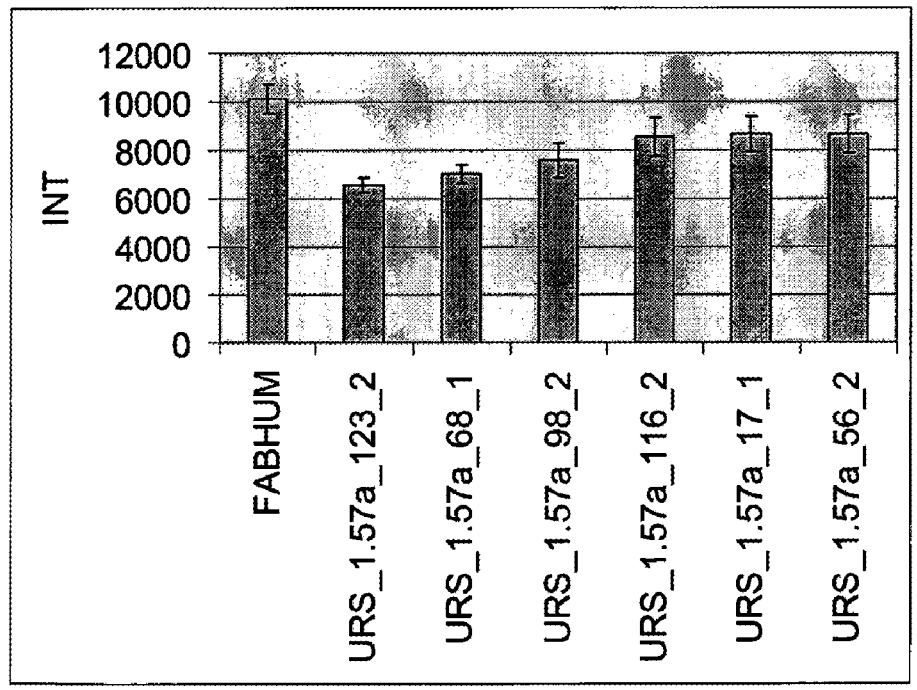
Figure 13D:
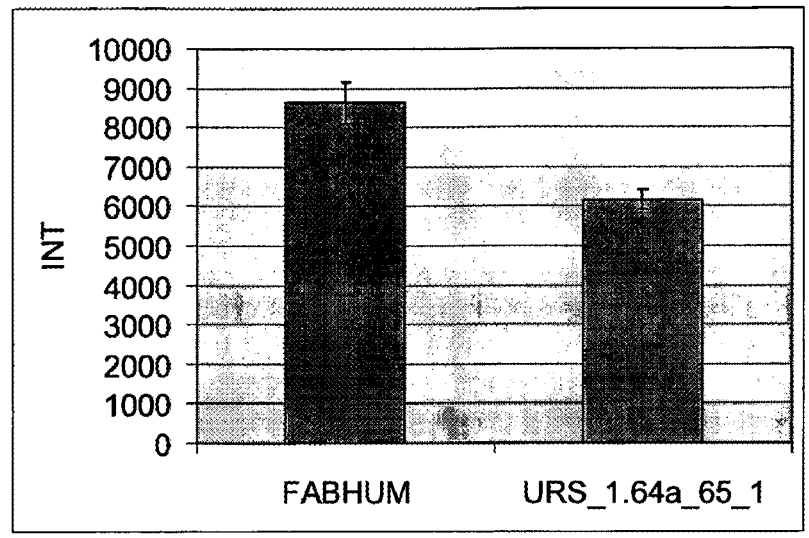
Figure 13E:
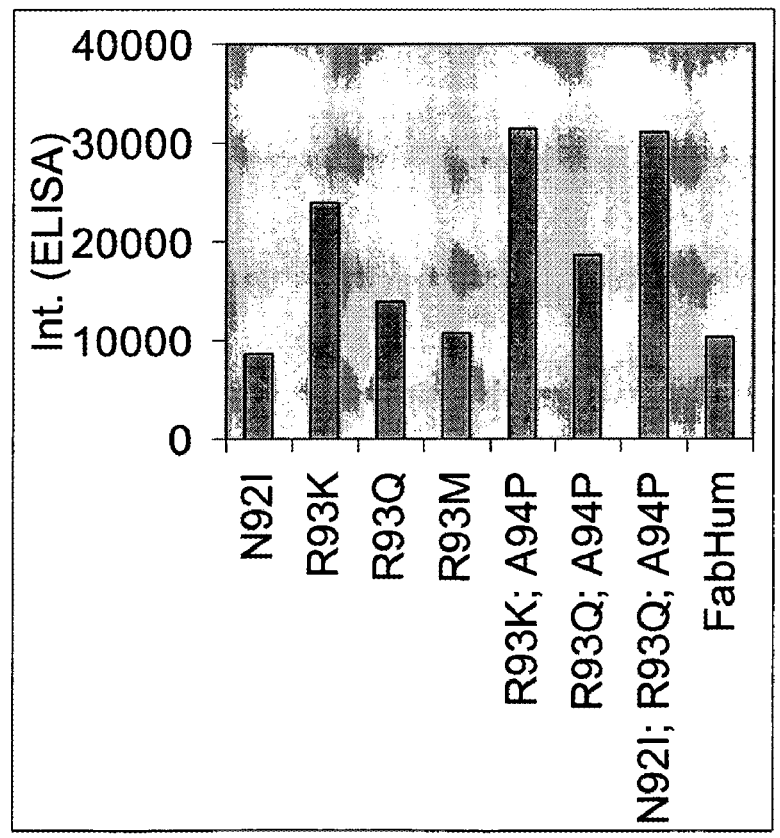
FIG. 13E is a chart showing data from an ELISA assay.
Figure 15A:
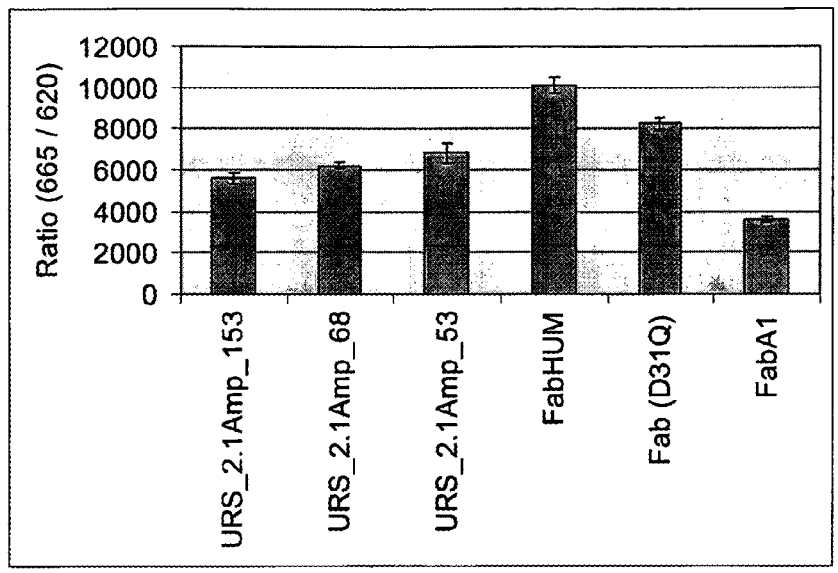
FIG. 15A-15E are charts showing data from a homogenous time-resolved energy transfer assay using the indicated variants from FIG. 14 compared to FabHUM.
Figure 15B:
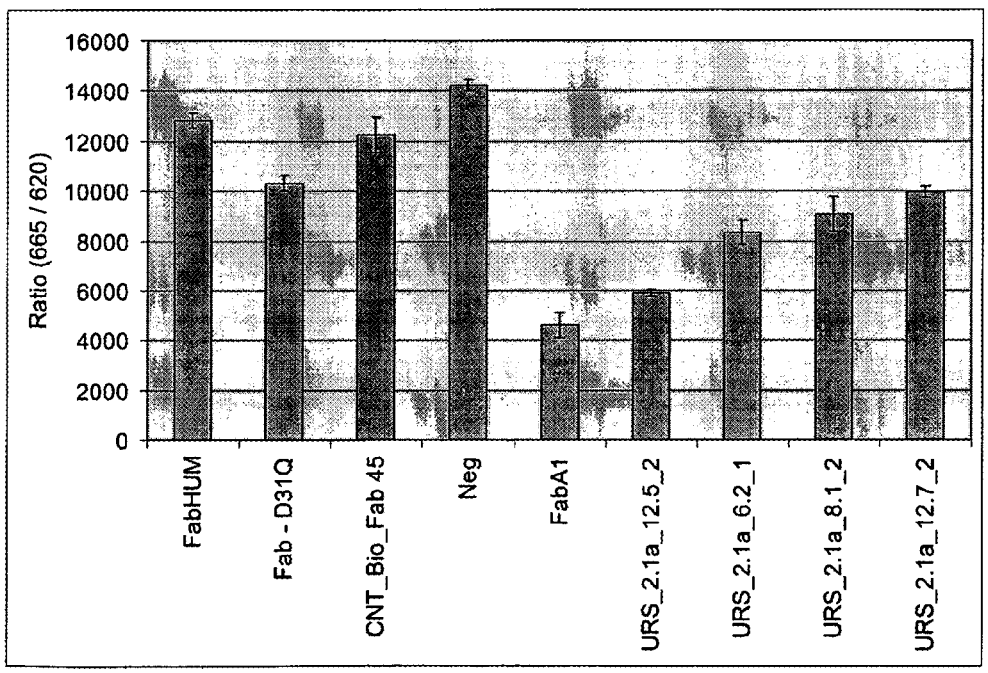
Figure 15C:
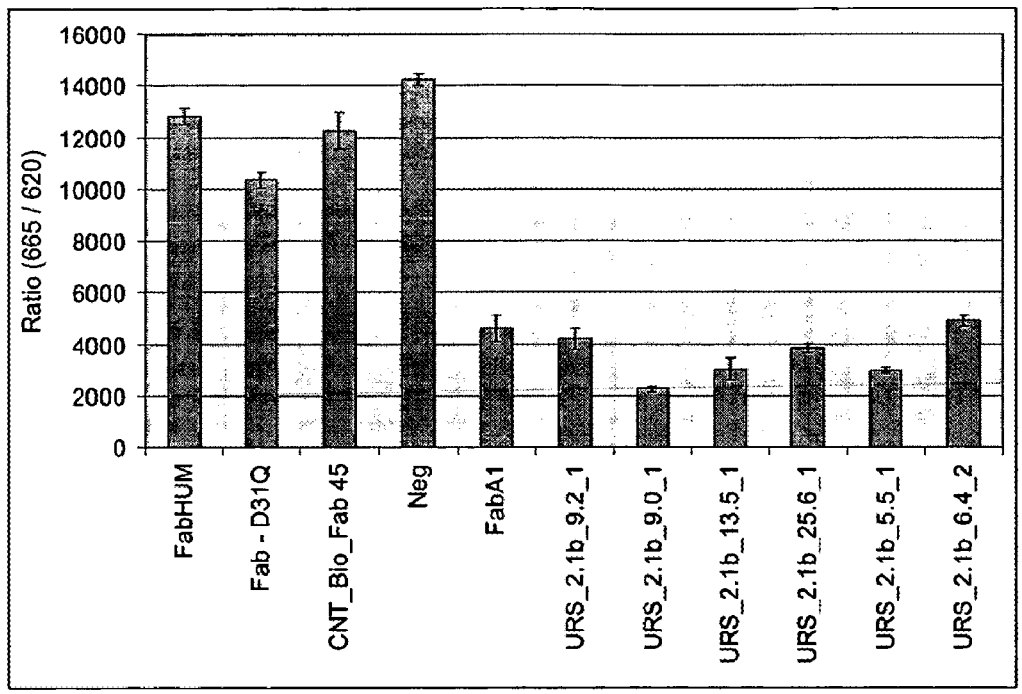
Figure 15D:
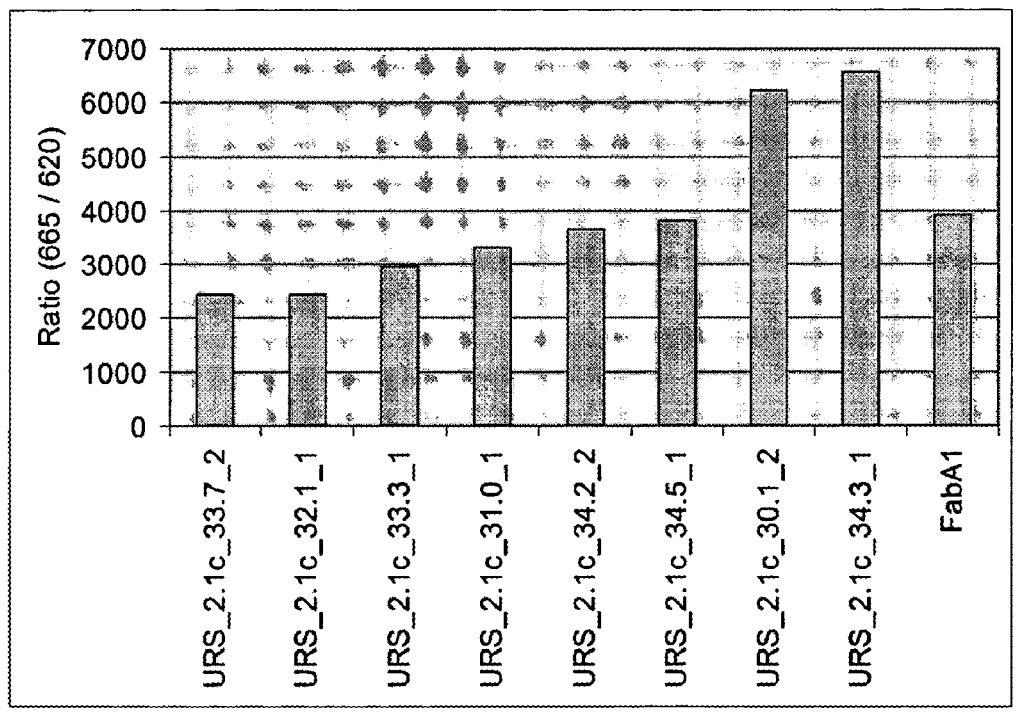
Figure 15E:
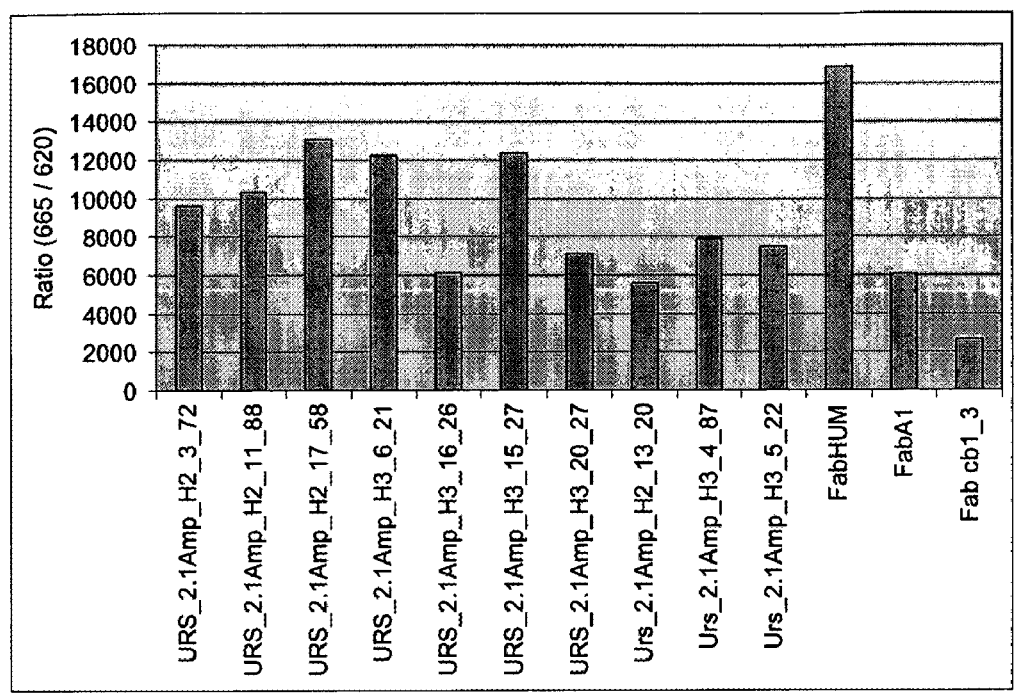
Figure 18A:
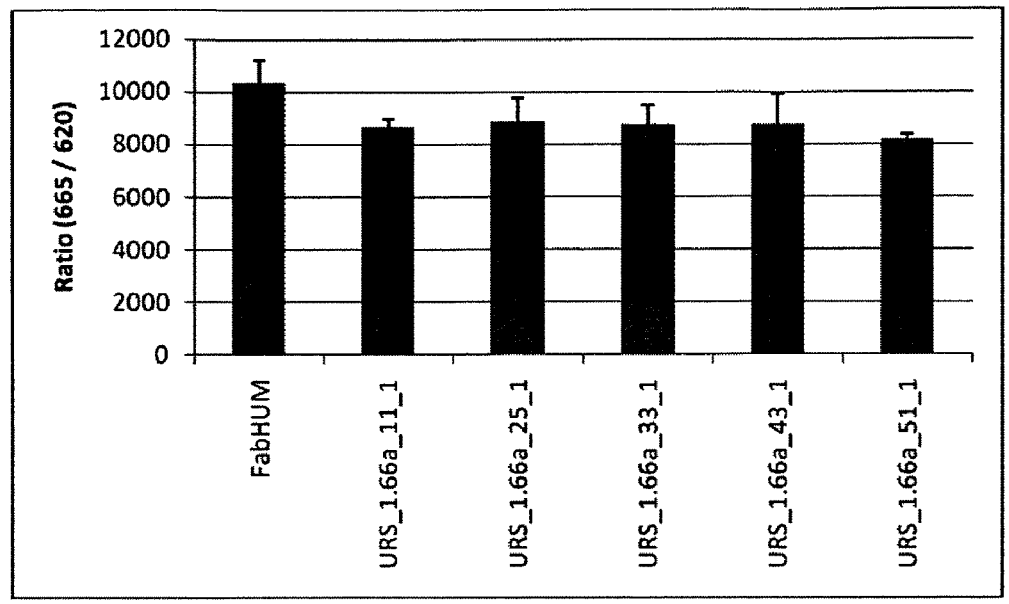
FIG. 18A-B are charts showing data from a homogenous time-resolved energy transfer assay using the indicated variants from FIG. 17 compared to FabHUM.
Figure 18B:
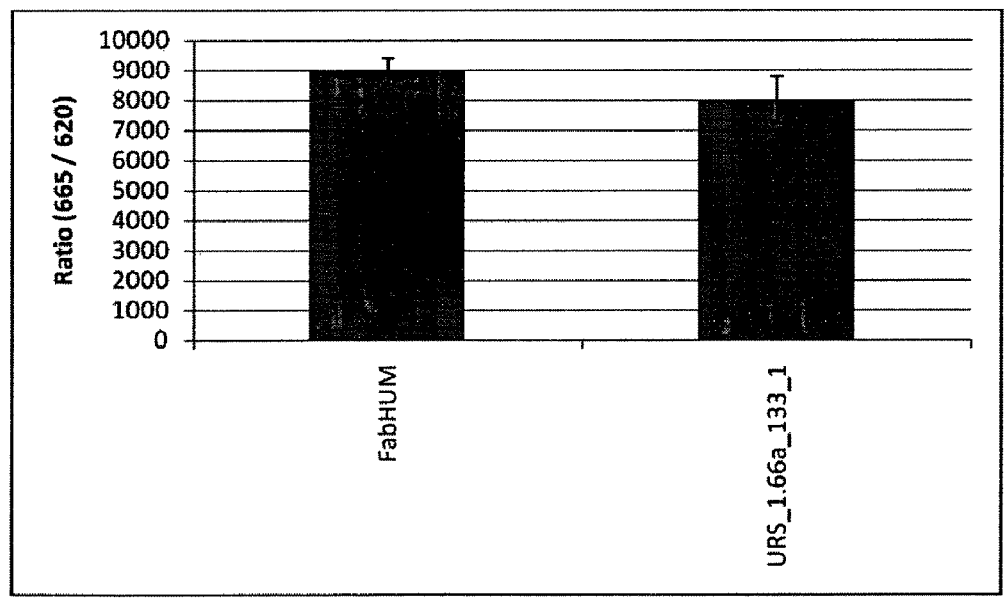
Figures 19, 20:
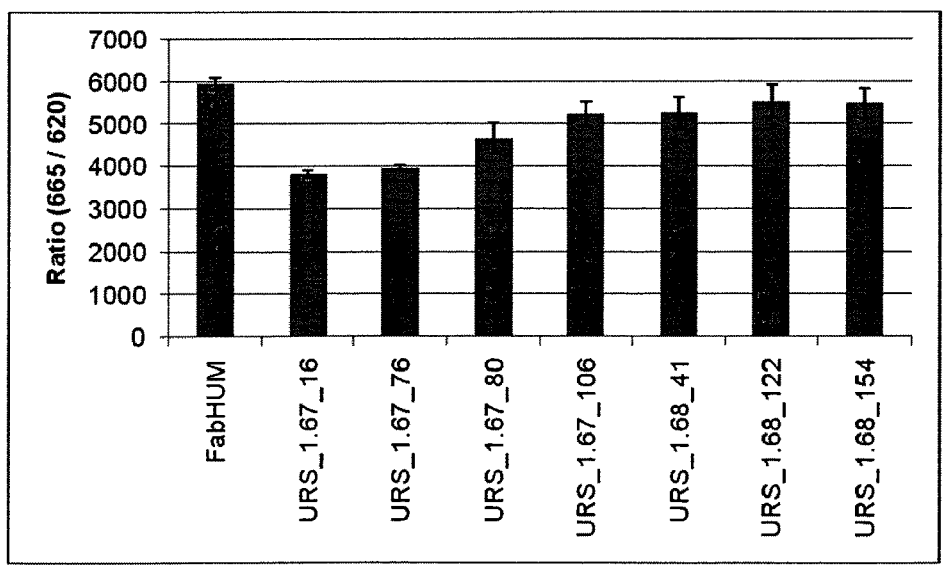
FIG. 19 is a Table showing variants provided herein having heavy and light chains with the indicated altered residues compared to the corresponding base sequences (wild type).
FIG. 20 is a chart showing data from a homogenous time-resolved energy transfer assay using the indicated variants from FIG. 19 compared to FabHUM.
Figure 22A:
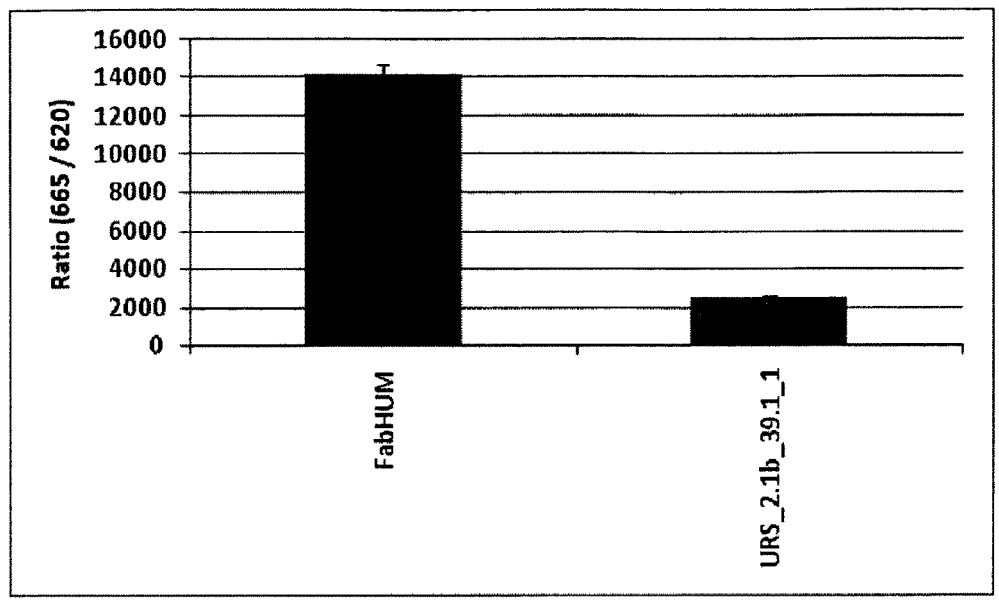
FIG. 22A-K are a charts showing data from a homogenous time-resolved energy transfer assay using the indicated variants from FIG. 21 compared to FabHum-D31Q.
Figure 22B:
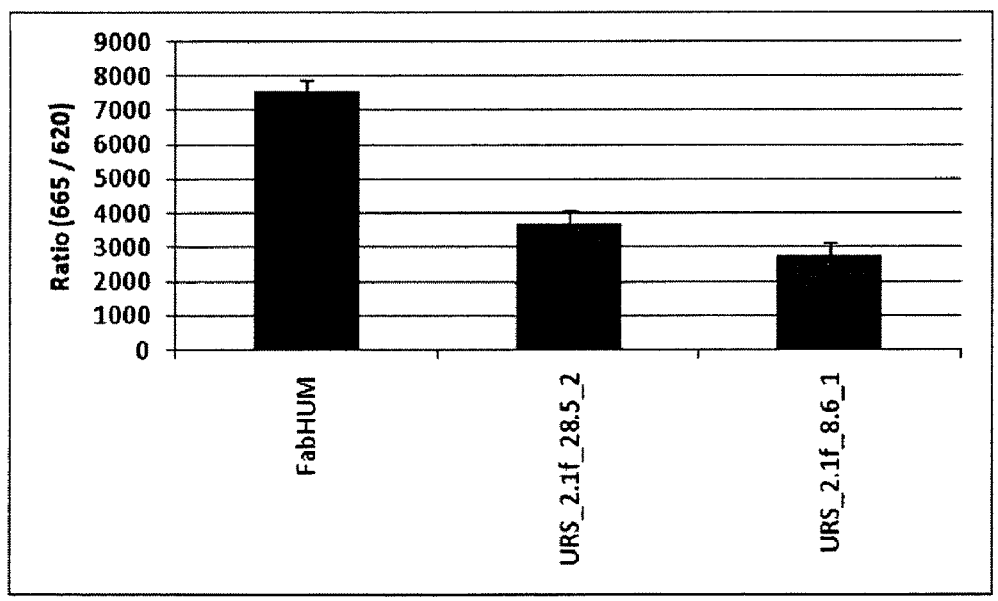
Figure 22C:
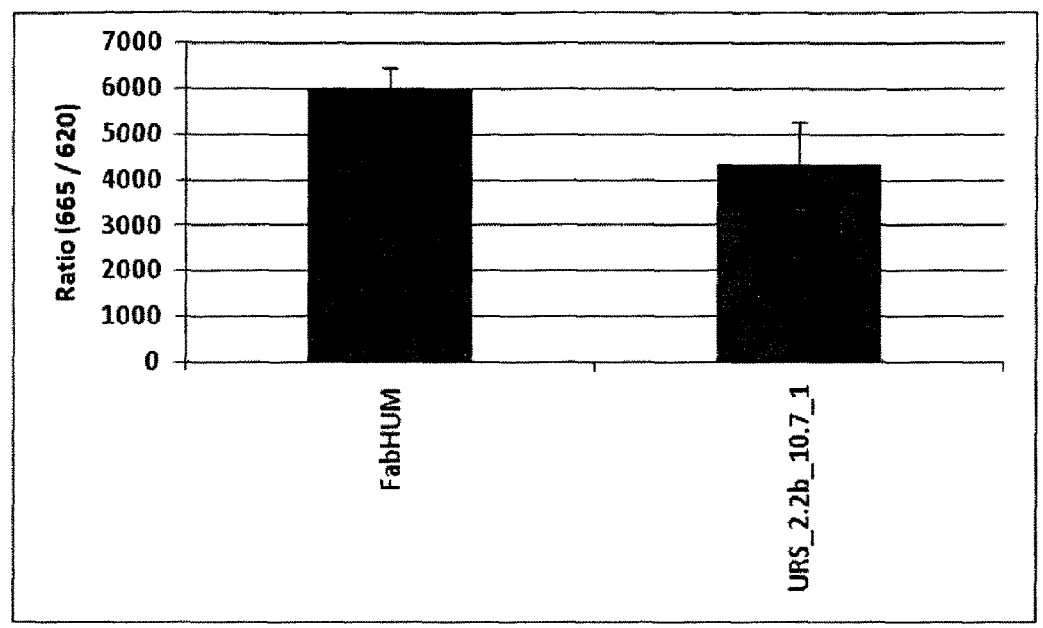
Figure 22D:
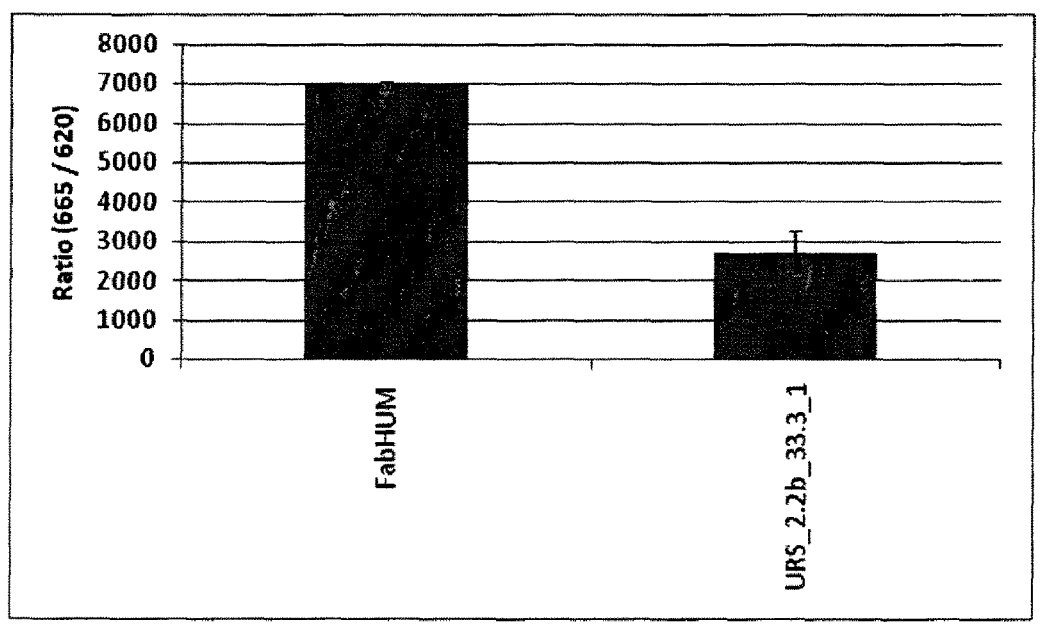
Figure 22E:
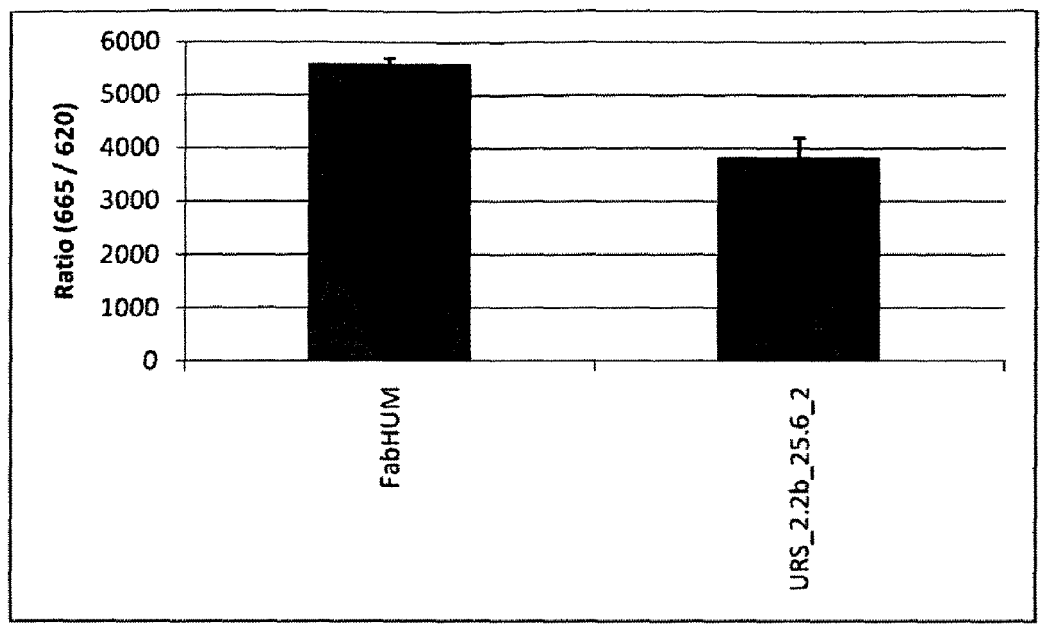
Figure 22F:
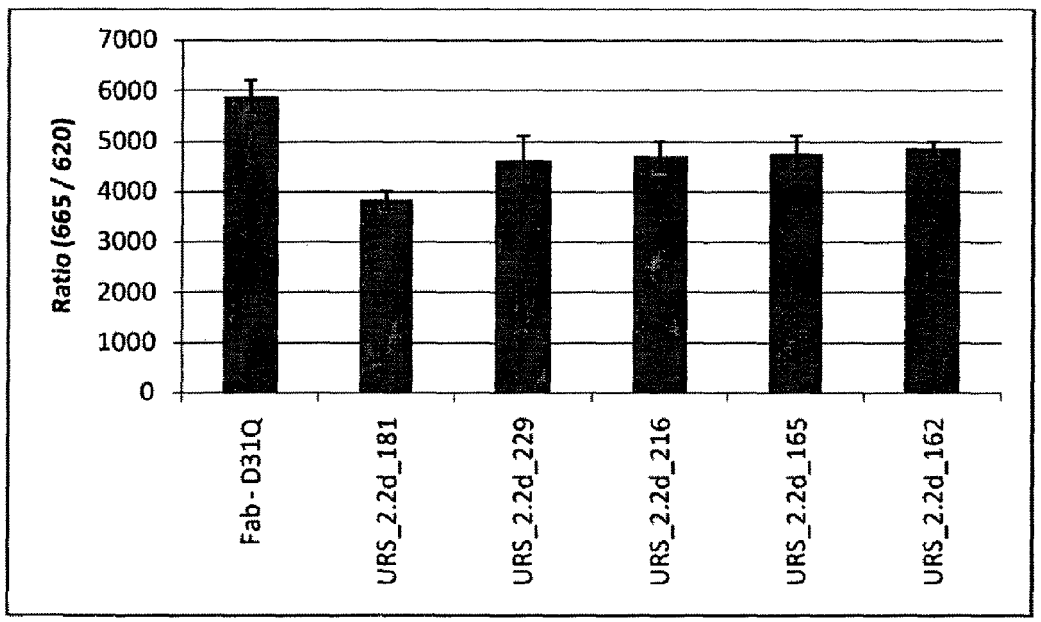
Figure 22G:
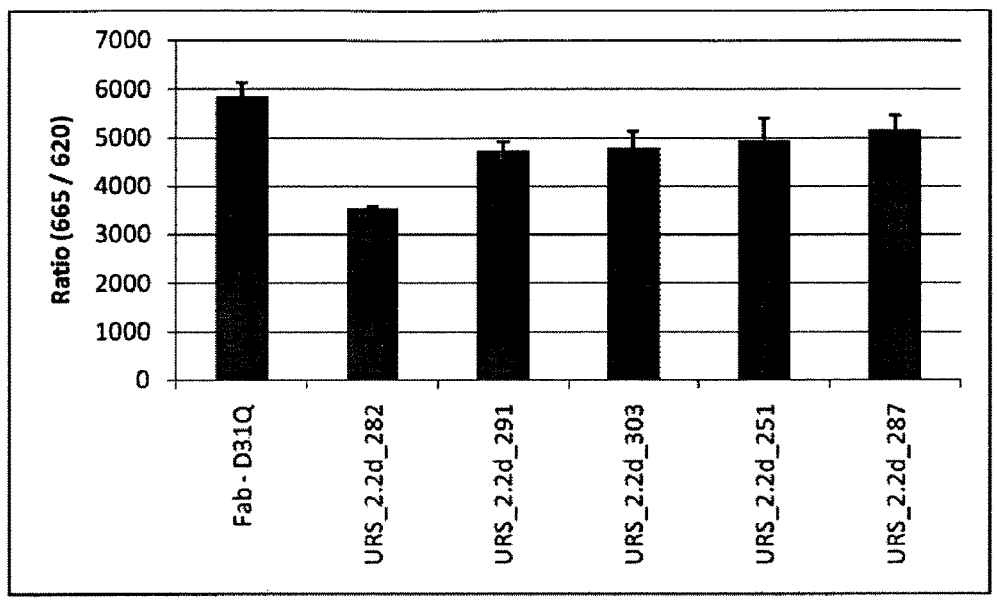
Figure 22H:
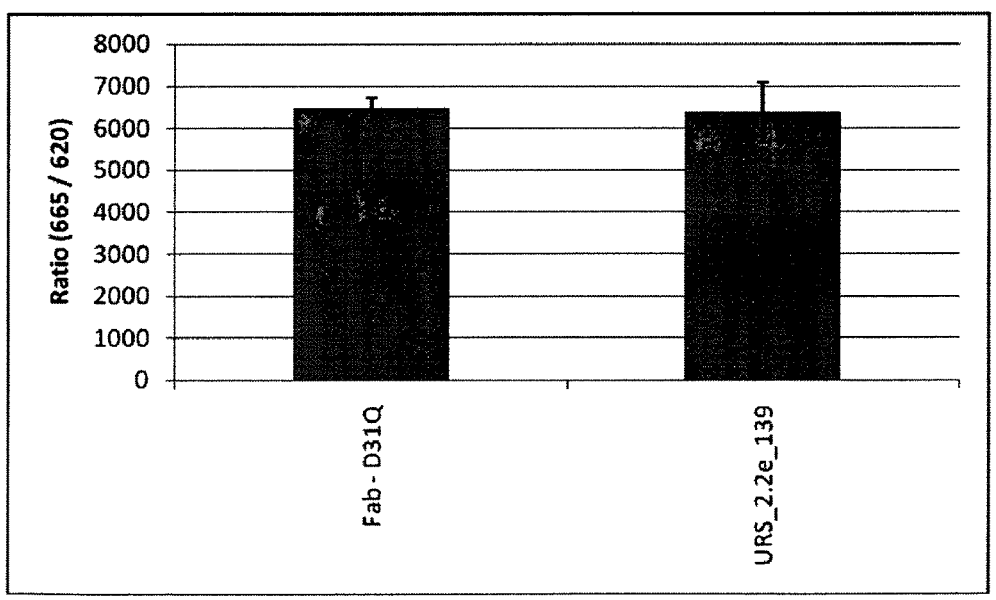
Figure 22I:
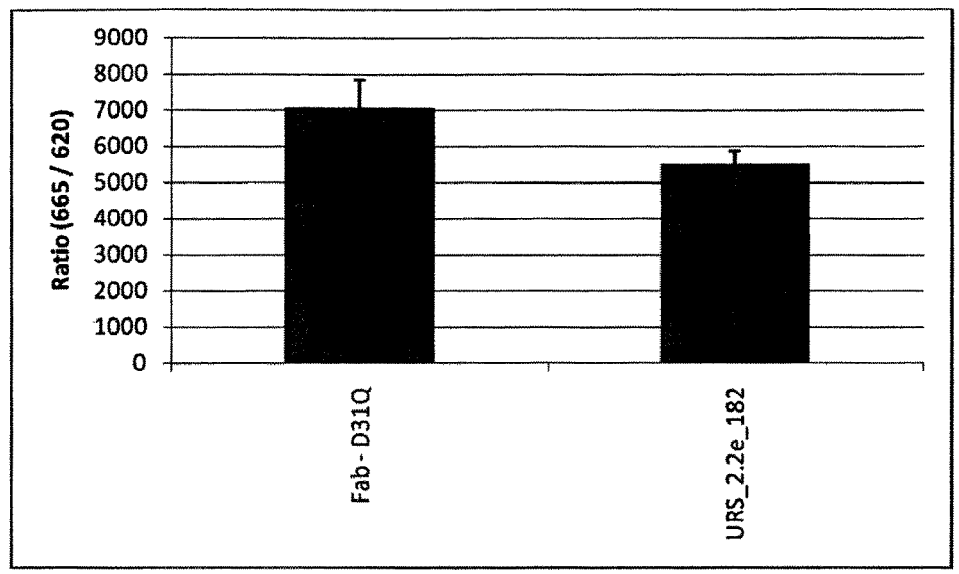
Figure 22J:
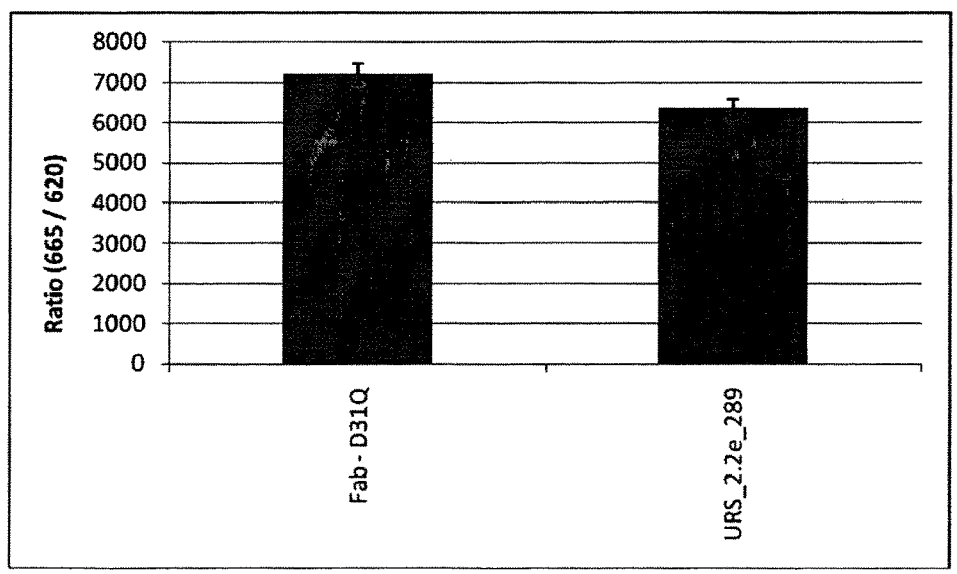
Figure 22K:
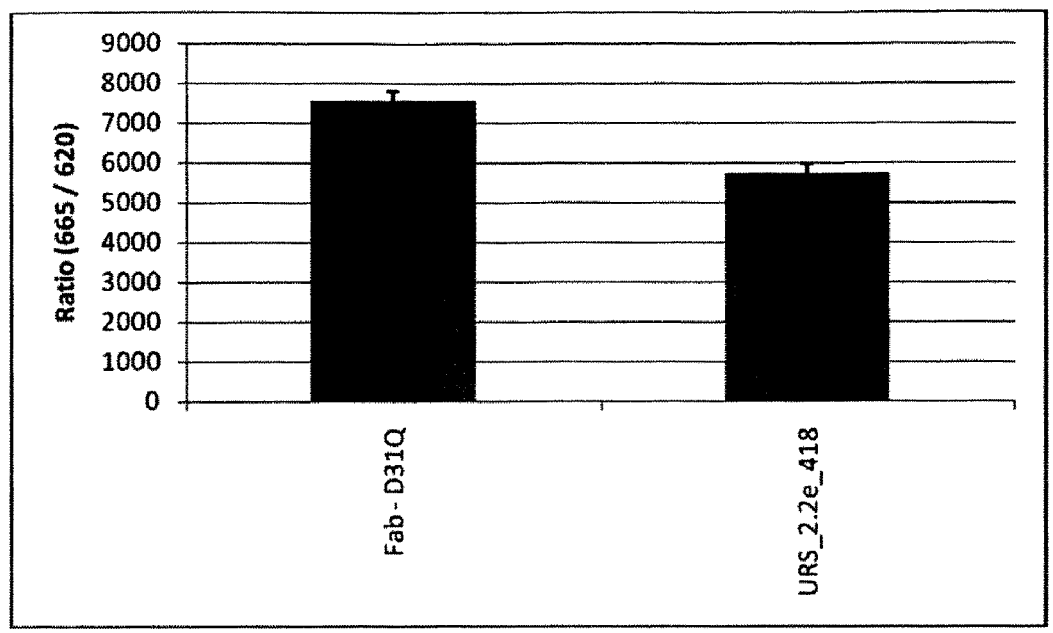
Figure 24A:
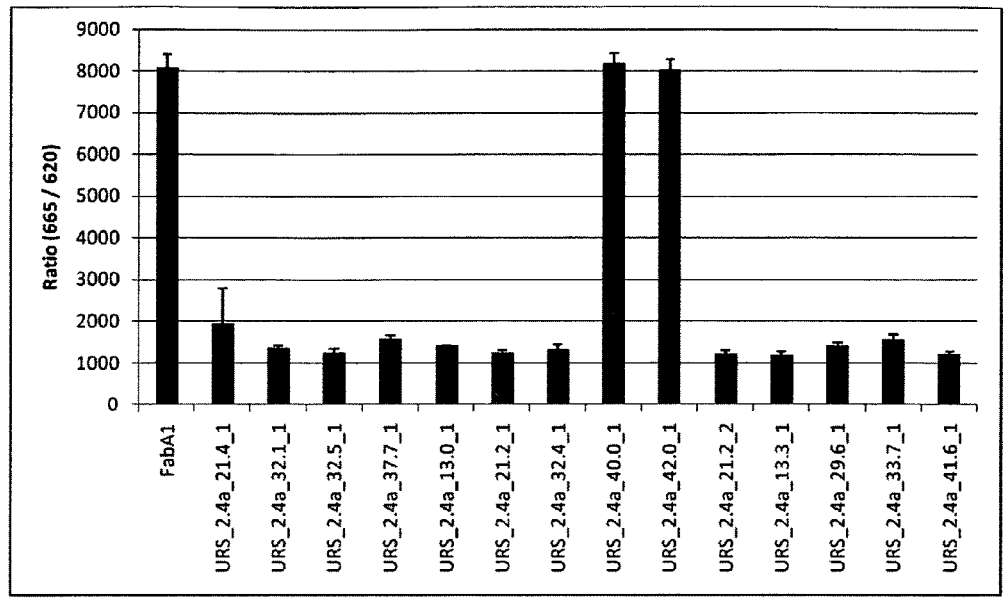
FIG. 24A-F are a charts showing data from a homogenous time-resolved energy transfer assay using the indicated variants from FIG. 23 compared to FabHUM (FabA1) or Fabcb1-3.
Figure 24B:
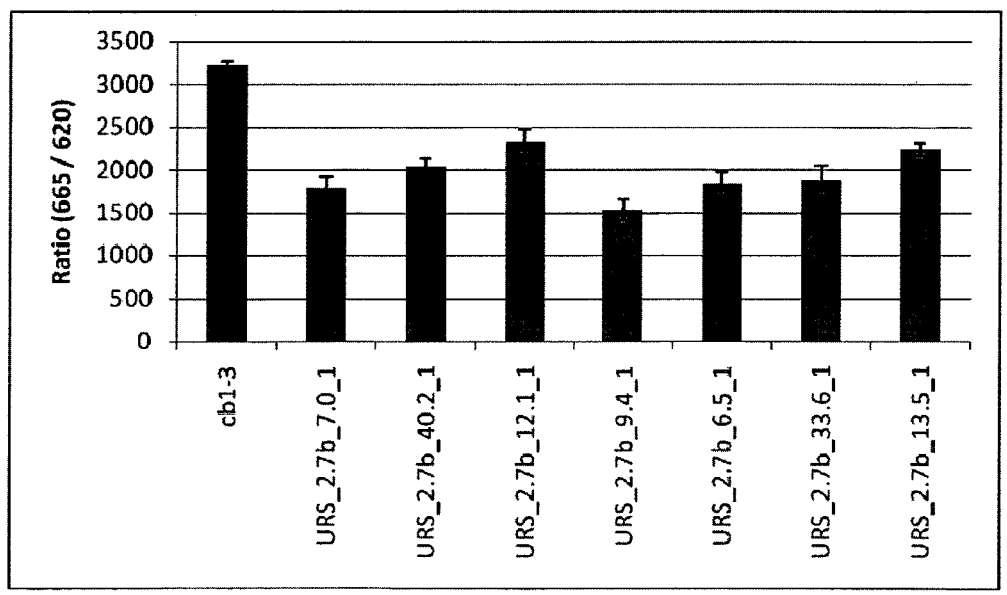
Figure 24C:
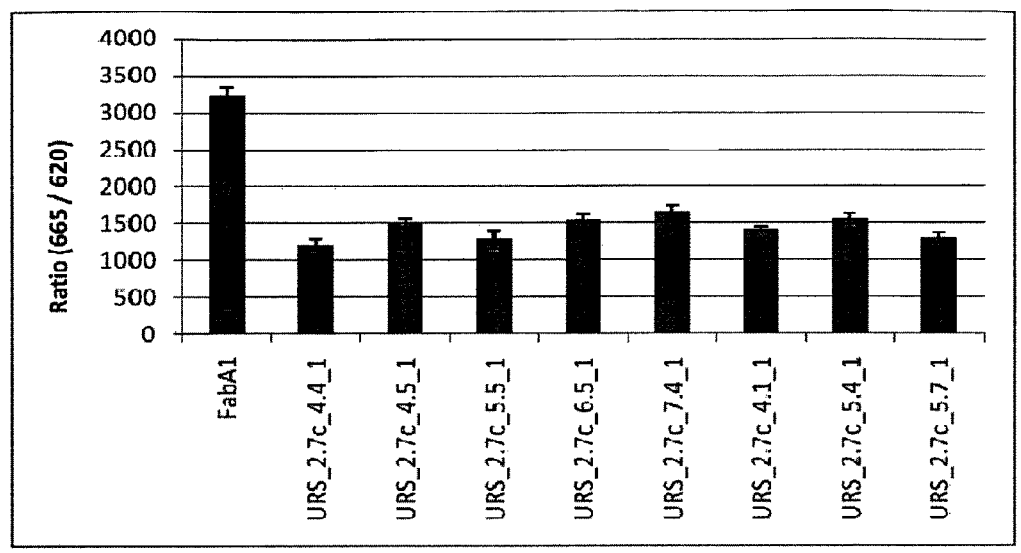
Figure 24D:
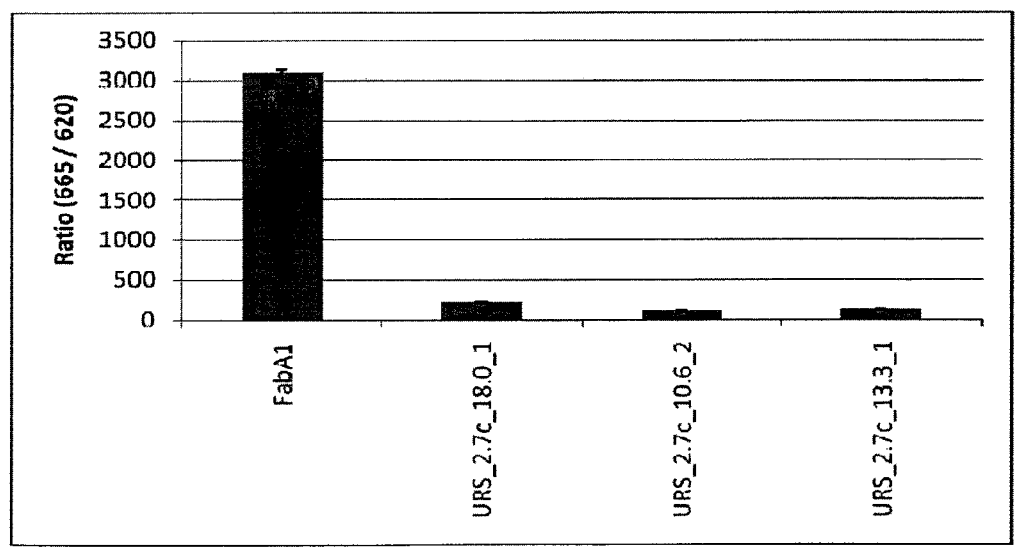
Figure 24E:
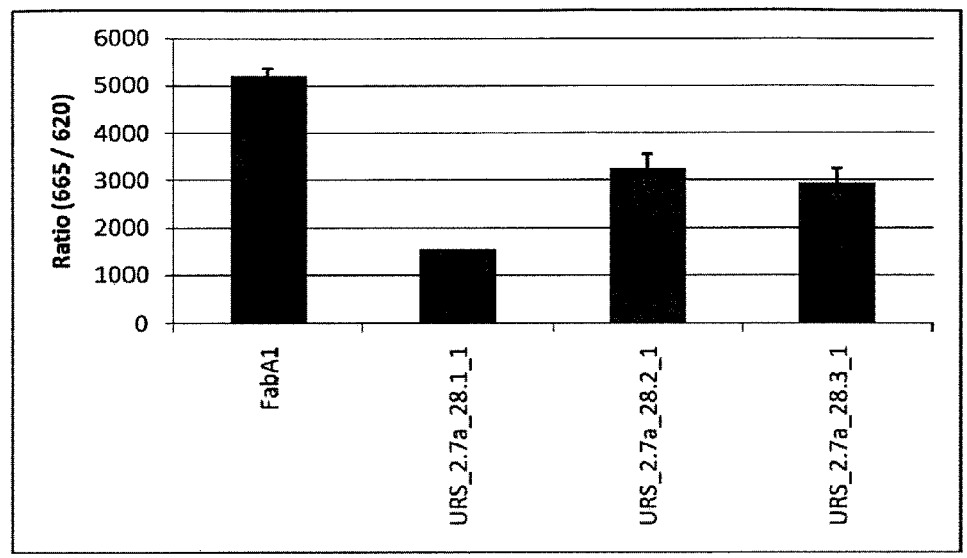
Figure 24F:
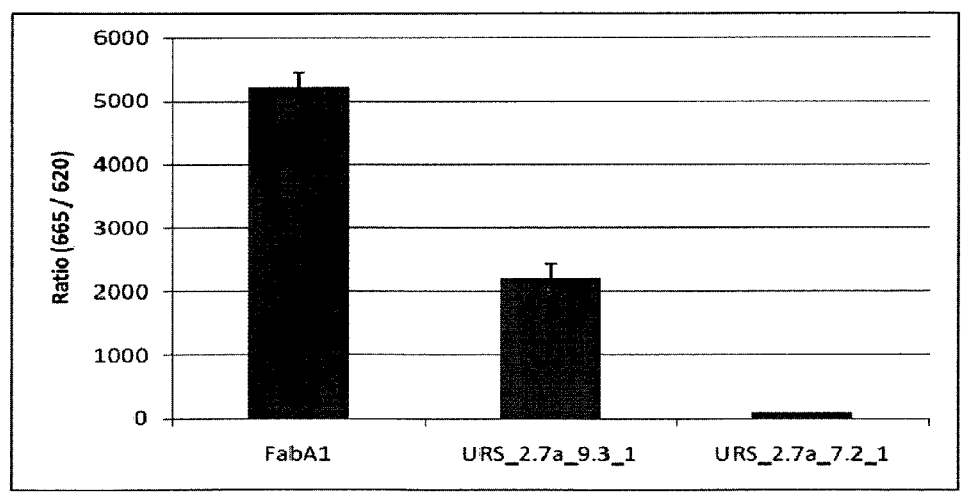
Figure 26A:
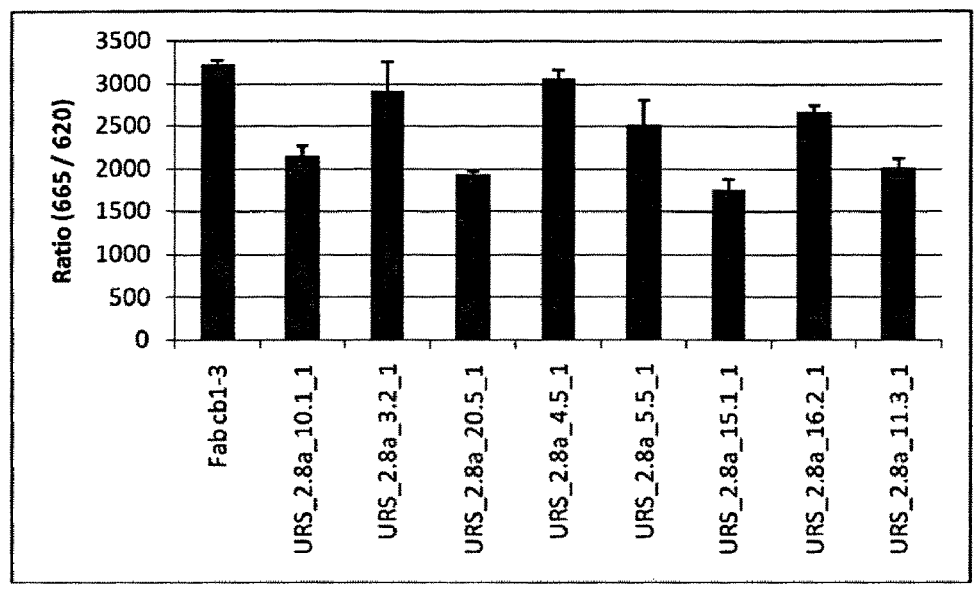
FIG. 26A-E are a charts showing data from a homogenous time-resolved energy transfer assay using the indicated variants from FIG. 25 compared to FabHUM (FabA1), FabHum-D31Q or Fabcb1-3.
Figure 26B:
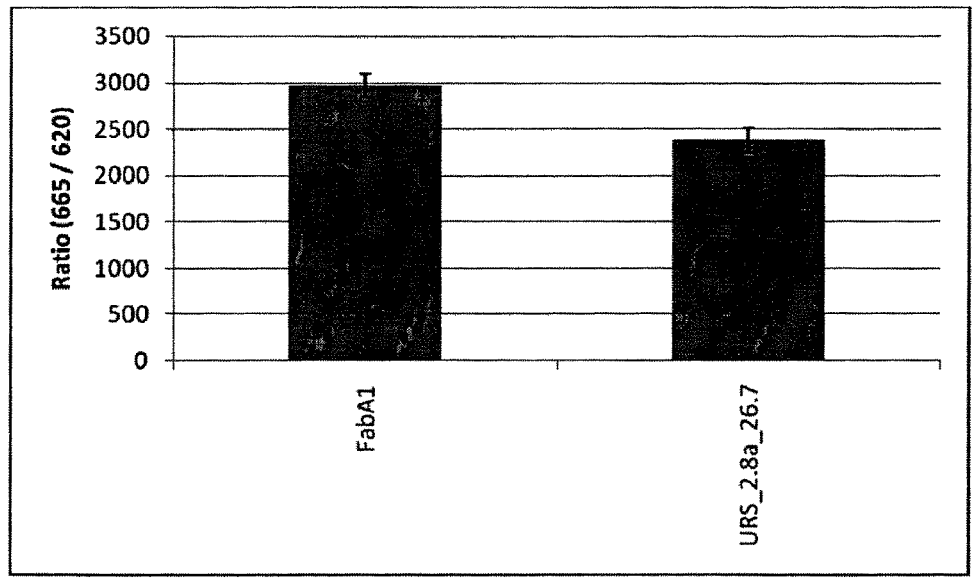
Figure 26C:
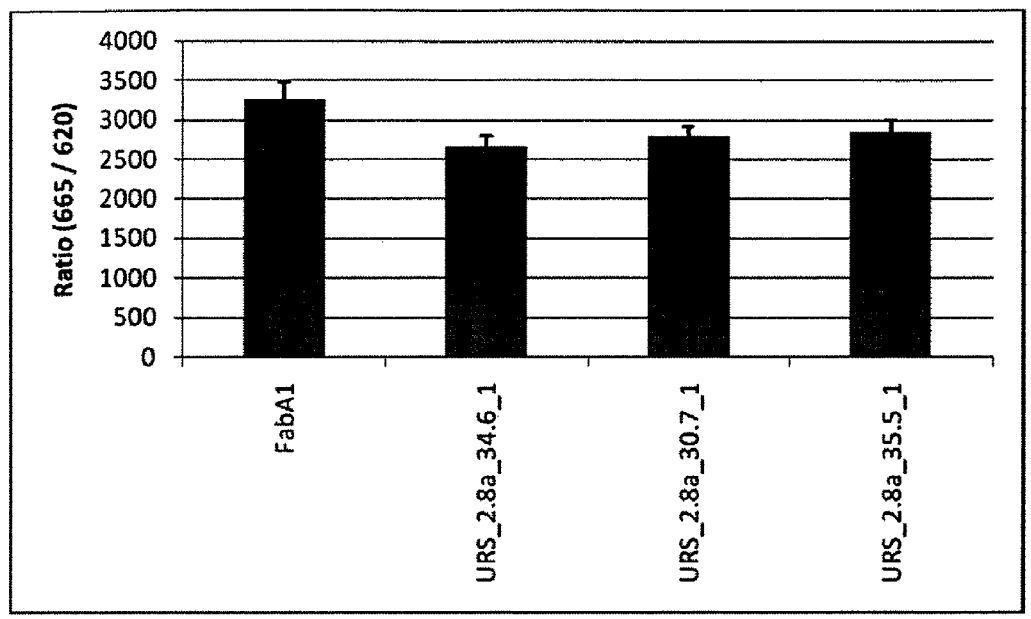
Figure 26D:
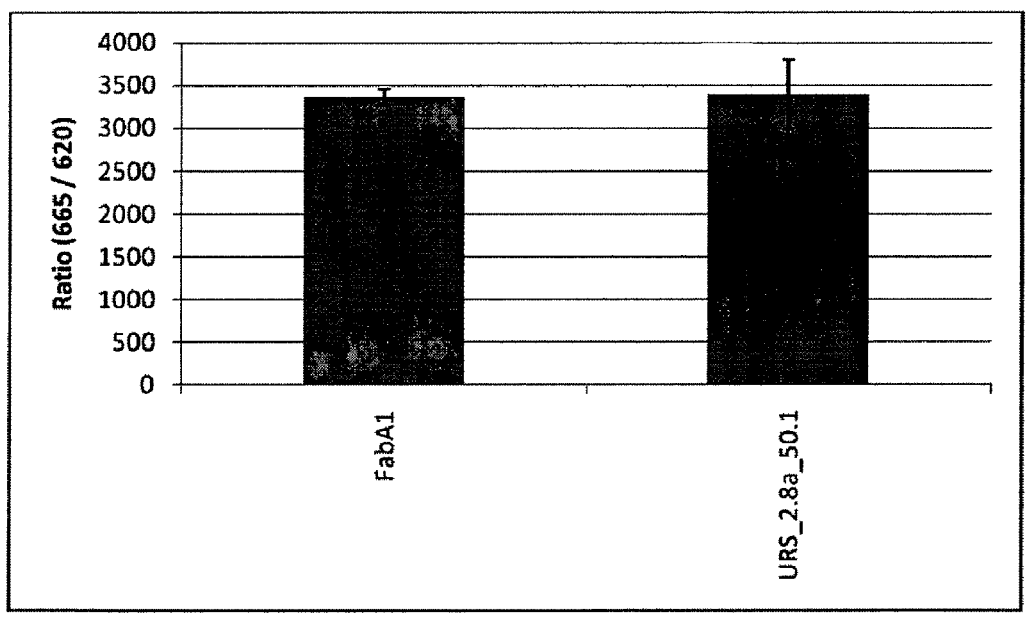
Figure 26E:
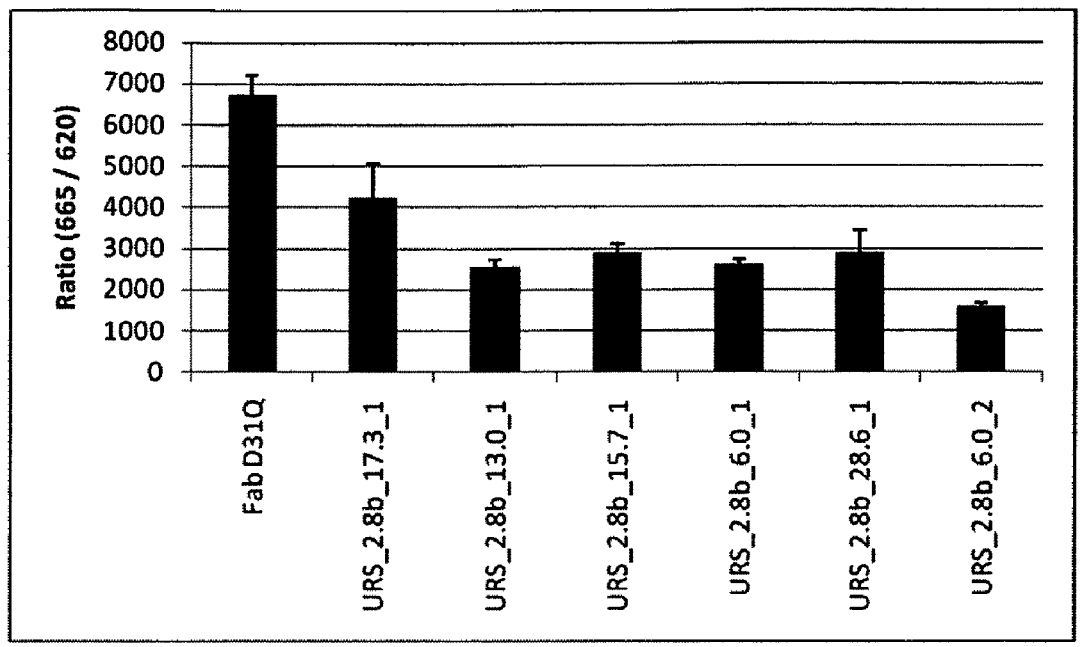
Figure 28A:
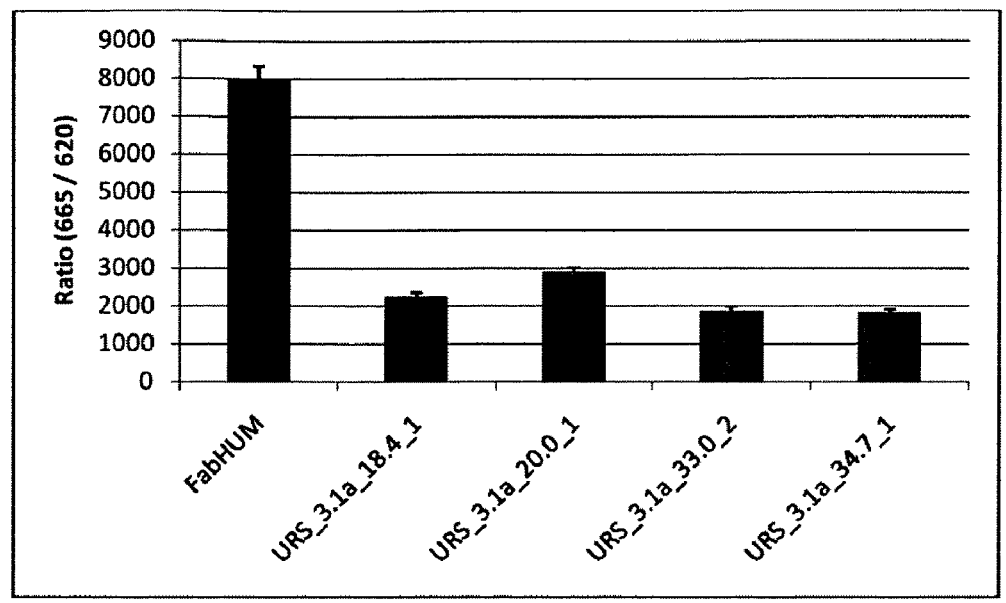
FIG. 28A-F are a charts showing data from a homogenous time-resolved energy transfer assay using the indicated variants from FIG. 27 compared to FabHUM.
Figure 28B:
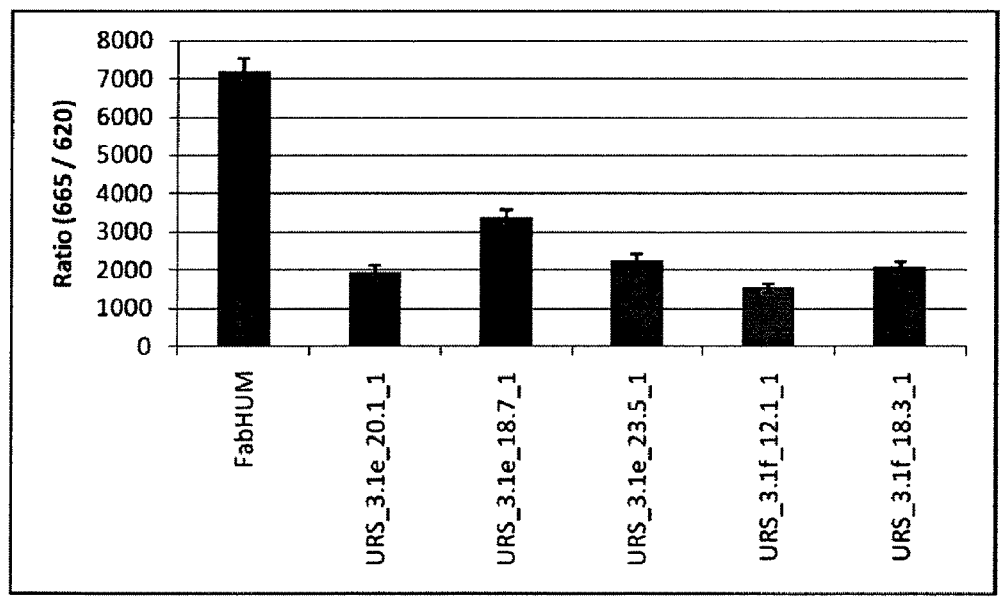
Figure 28C:
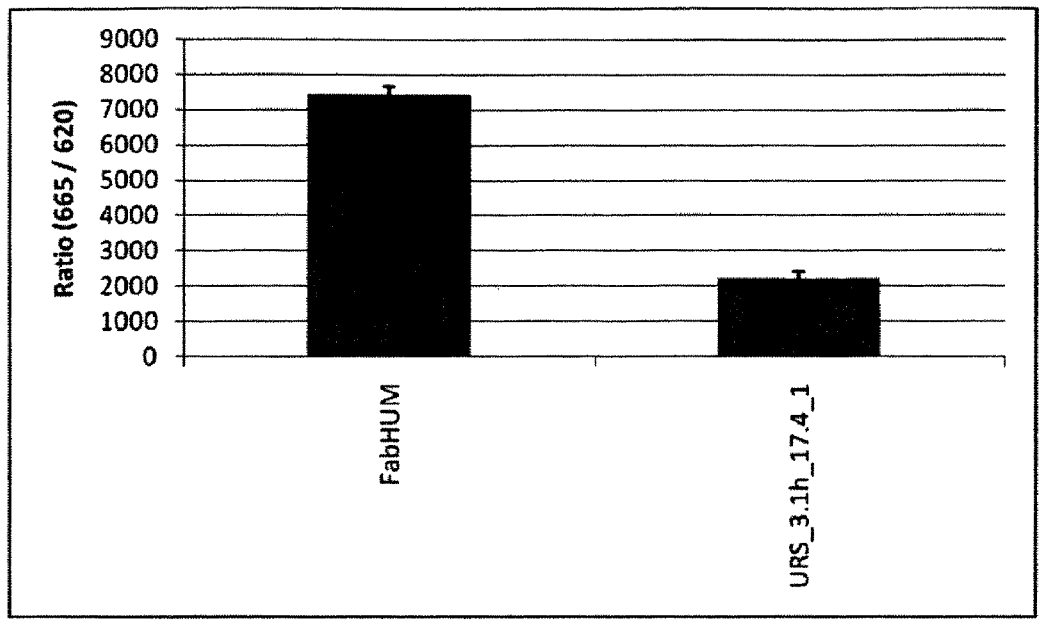
Figure 28D:
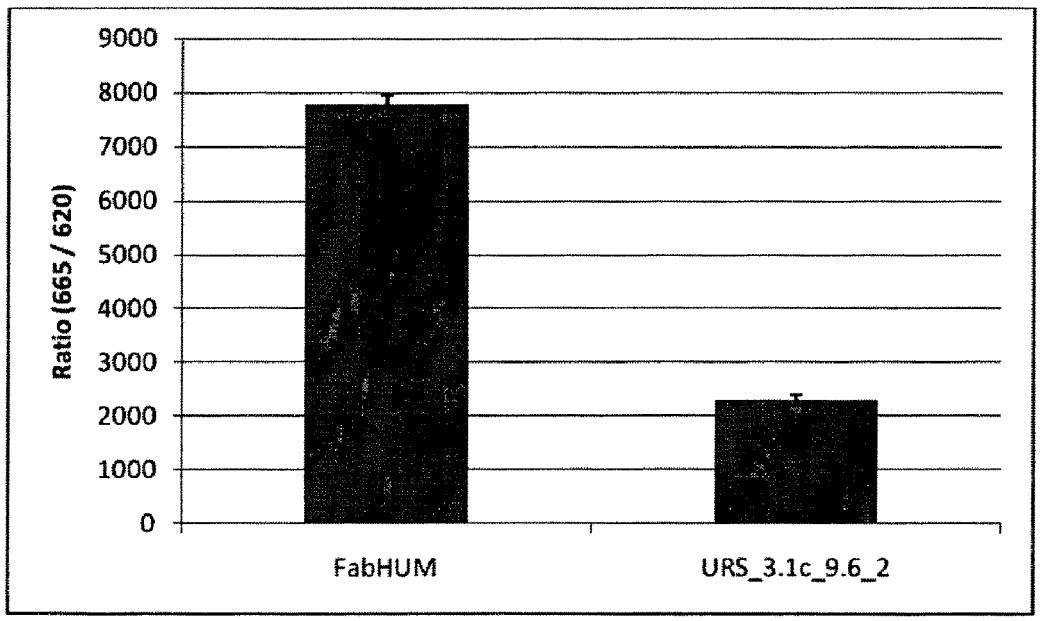
Figure 28E:
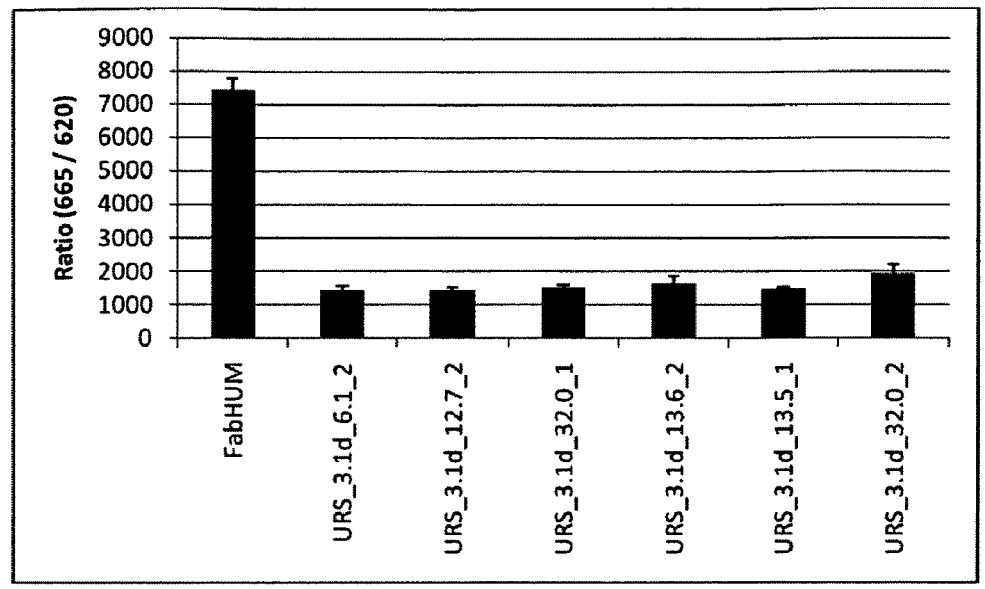
Figure 28F:
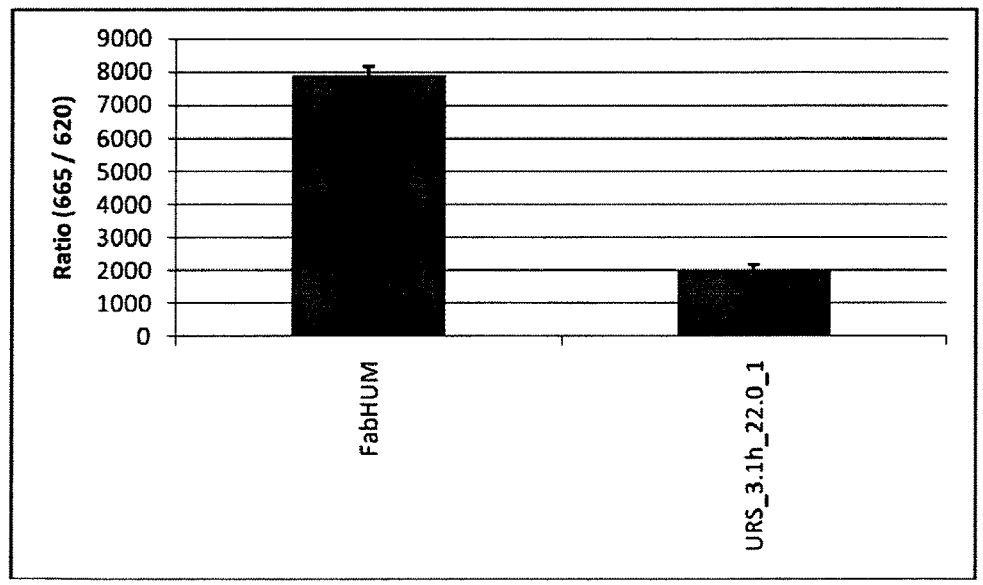
Figure 30A:
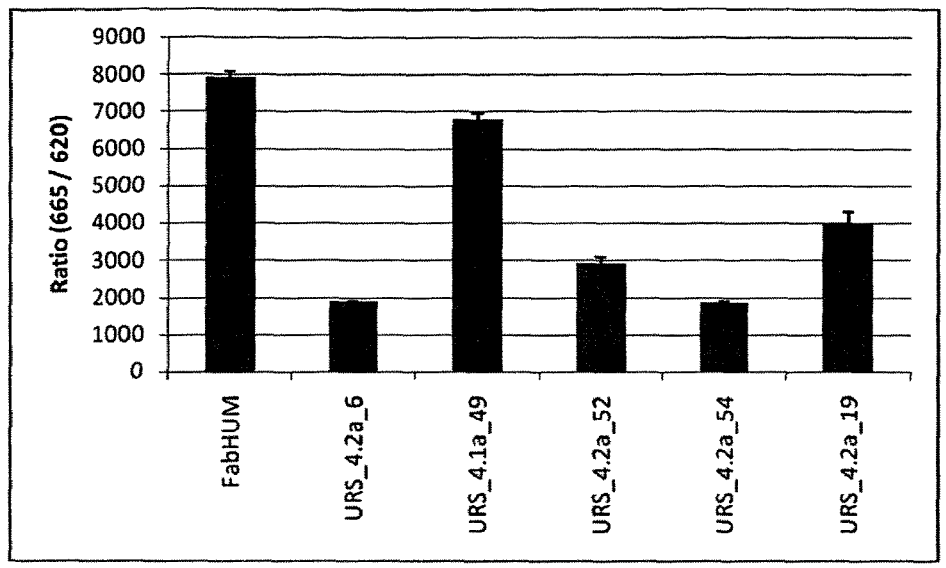
FIG. 30A-B are a charts showing data from a homogenous time-resolved energy transfer assay using the indicated variants from FIG. 29 compared to FabHUM.
Figure 30B:
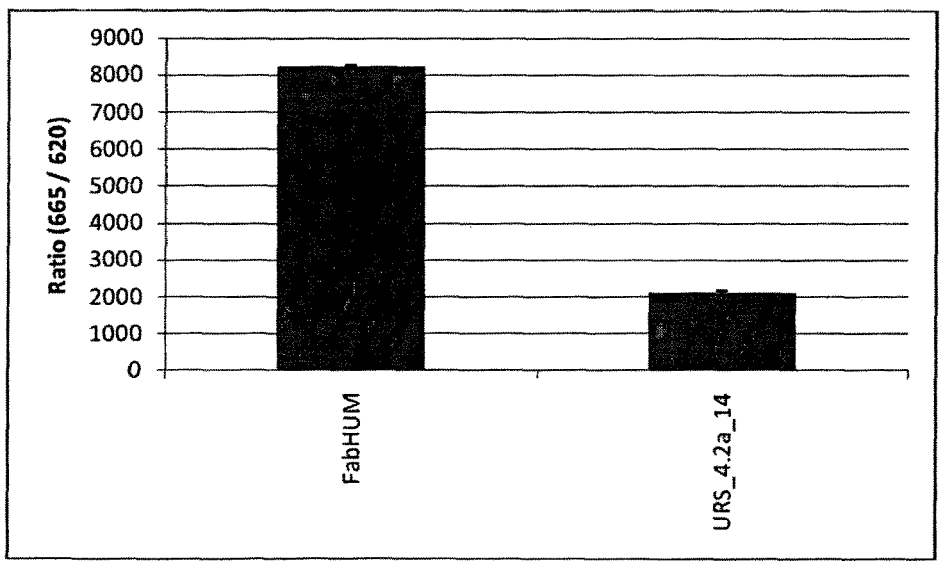

FIG. 12 shows a table of variant light chains having the indicated variations in sequence compared to the base sequence. The alterations in amino acid sequence compared to the base sequence (wild type) is shown in bold letters. The "amino acid number" refers to the position of the amino acid according to the numbering provided in SEQ ID NO. 2. FIG. 13A-13D show the results of HTRF® comparing the variants of FIG. 12 to FabHUM. As shown in the charts, many of the variants of FIG. 12 had at least as strong of an affinity to TNFα as the positive control, FabHUM. FIG. 13E shows the results of an ELISA assay. As shown in FIG. 13E, the single substitution N92I resulted in an impairment of affinity towards TNFα, whereas the same substitution increases the affinity of the R93Q; A94P double mutant. Therefore, the triple mutant N92I; R93Q; A94P shows synergistic affinity improvement.

FIG. 14 shows a table of variant light chains and variant heavy chains having the indicated variations in sequence compared to the base sequence. The alterations in amino acid sequence compared to the base sequence (wild type) is shown in bold letters. The "amino acid number" refers to the position of the amino acid according to the numbering provided in SEQ ID NO. 2 and 1, respectively. FIG. 15A-15E show the results of HTRF® comparing the variants of FIG. 14 to FabHUM. As shown in the charts, many of the variants of FIG. 14 had at least as strong of an affinity to TNFα as the positive control, FabHUM.

EXAMPLES

Expression of Full Length Antibodies:

The D2E7 and variant light and heavy chain genes were separately cloned into pCEP4 (Invitrogen). The light and heavy chain vectors were cotransfected into HEK cells using PEI following standard procedures in a volume of 60 ml in 250 ml Erlenmeyer flasks. Cells were grown in 293freestyle (Invitrogen) supplemented with 0.25% GPN3 (Organotechnie). After 5 days supernatants were harvested and analysed. See FIG. 34 for sequences.

Figure 32:
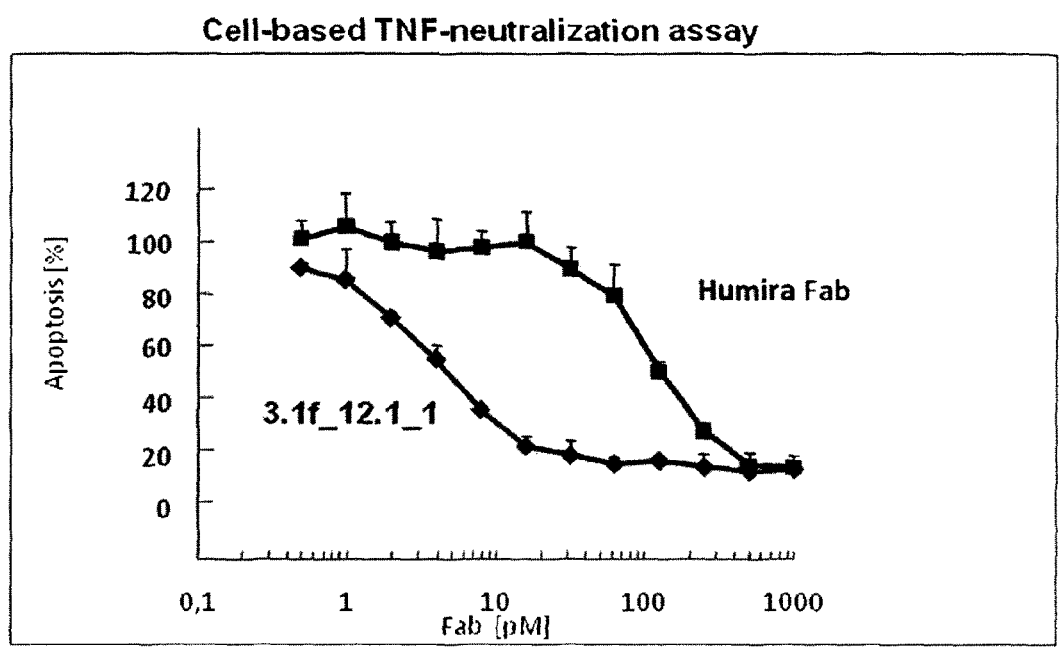
FIG. 32 is a graph showing the results of a cell-based TNF-alpha neutralization assay, comparing FabHUM with a variant of the invention.

TNF-Alpha Neutralization Cell Based Bioassay:

TNF-responsive cells were plated in 384 well plates and incubated over night. 300 pg/ml TNF was preincubated with various antibody concentrations for 30 minutes at room temperature. The mixtures were added to the cells and incubated for 6 h at 37 degrees. TNF-induced caspase activation was measured using the caspase glo 3/7 kit (Promega) following the manufacturer's instructions. The variants of the invention are neutralizing antibodies by suppressing TNF-alpha induced apoptosis, see FIG. 32.

Figure 31:
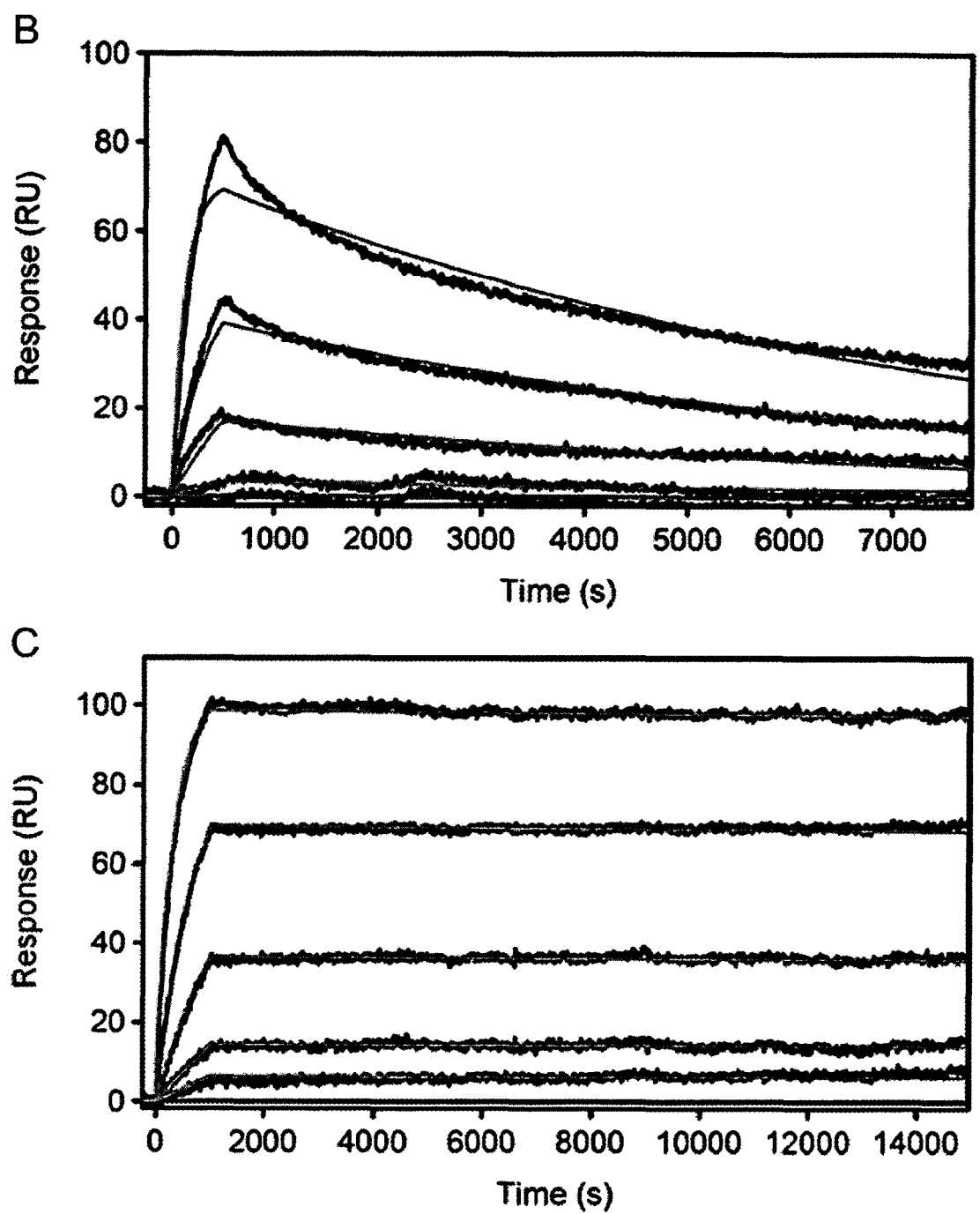
FIG. 31A is a Table showing the association constant ka, the dissociation constant kd and the affinity constant $K_D$ of variants provided herein in comparison with FabHum determined by surface plasmon resonance analysis.
FIG. 31B is a graph showing data from surface plasmon resonance analysis of FabHum.
FIG. 31C is a graph showing data from surface plasmon resonance analysis of URS_4.2a_52.

SPR-Analysis:

Surface plasmon resonance analysis: TNFα preparations were immobilized onto a GLC sensor chip within a ProteOn XPR biosensor (BioRad Laboratories) using standard amine coupling. The surfaces were activated for 5 minutes with sulf-NHS/EDC (0.01M/0.04 M), then the TNFα was injected at 1 ug/ml in 10 mM NaAcetate, pH 4.5 for 5 minutes and finally the surfaces were blocked with a 5 minute injection of 1 M ethanolamine pH 8.1. TNFa immobilization levels were between 400 and 500 RU. Fabs were tested at 10 nM as the highest concentration in a 3-fold dilution series. The running buffer contained 10 mM HEPES, 150 mM NaCl, pH 7.4, with 0.005% tween-20 and 0.1 mg/mL BSA. Binding data were collected at 25 degrees C. The binding kinetics were determined by globally fitting the response data to a simple 1:1 interaction model using Scrubber (Biologic Software Pty Ltd, Australia). FIG. 31 showing data of the SPR analysis for some variants of the invention.

Table 1 is showing the variants of the invention and the corresponding SEQ ID NO. For example the sequence of the heavy chain of URS_1i!L_1.12A_20.1_2 has SEQ ID NO: 63 and the sequence of the light chain of URS_1i!L_1.12A_20.1_2 has SEQ ID NO: 64. When no corresponding heavy or light chain is indicated the D2E7 heavy or light chain is used.

TABLE 1

| Binder | SEQ ID NO |
| --- | --- |
| URS_1.12_50 - Heavy chain | SEQ ID NO: 57 |
| URS_1.12_87 - Heavy chain | SEQ ID NO: 58 |
| URS_1.12_103 - Heavy chain | SEQ ID NO: 59 |
| URS_1.12_47 - Heavy chain | SEQ ID NO: 60 |
| URS_1.12_84 - Heavy chain | SEQ ID NO: 61 |
| URS_1i!L_1.12A_7.0_1 - Heavy chain | SEQ ID NO: 62 |
| URS_1i!L_1.12A_20.1_2 - Heavy chain | SEQ ID NO: 63 |
| URS_1i!L_1.12A_20.1_2 - Light chain | SEQ ID NO: 64 |
| URS_1i!L_1.12A_11.2_2 - Heavy chain | SEQ ID NO: 65 |
| URS_1i!L_1.12A_15.0_2 - Heavy chain | SEQ ID NO: 66 |
| URS_1i!L_1.12A_6.5_2 - Heavy chain | SEQ ID NO: 67 |
| URS_1i!L_1.12A_2.3_1 - Heavy chain | SEQ ID NO: 68 |
| URS_1i!L_1.12A_11.3_1 - Heavy chain | SEQ ID NO: 69 |
| URS_1i!L_1.13_12.2_2 - Heavy chain | SEQ ID NO: 70 |
| URS_1i!L_1.13_12.2_2 - Light chain | SEQ ID NO: 71 |
| URS_1.42a_22_2 x 2 - Heavy chain | SEQ ID NO: 72 |
| URS_1.42a_22_2 x 2 - Light chain | SEQ ID NO: 73 |
| URS_1.42a_105_1 x 2 - Heavy chain | SEQ ID NO: 74 |
| URS_1o!L1.19_29.3_2 - Heavy chain | SEQ ID NO: 75 |
| URS_1o!L1.19_29.5_1 - Heavy chain | SEQ ID NO: 76 |
| URS_2.1c!L1.15_12.1_1 - Heavy chain | SEQ ID NO: 77 |
| URS_1k!L_1.23_7.0_1 - Heavy chain | SEQ ID NO: 78 |
| URS_1.60a_120_2 - Heavy chain | SEQ ID NO: 79 |
| URS_1b!L1.29_11.2_2 - Light chain | SEQ ID NO: 80 |
| URS_1b!L1.29_10.2_2 - Light chain | SEQ ID NO: 81 |
| URS_1b!L1.29_12.5_1 - Light chain | SEQ ID NO: 82 |
| URS_1b!L1.29_11.7_1 - Light chain | SEQ ID NO: 83 |
| URS_1b!L1.29_11.1_1 - Light chain | SEQ ID NO: 84 |
| URS_1b!L1.29_11.3_1 - Light chain | SEQ ID NO: 85 |
| URS_1q!L1.31_38.5_1 - Light chain | SEQ ID NO: 86 |
| URS_1q!L1.31_38.6_2 - Light chain | SEQ ID NO: 87 |
| URS_1q!L1.31_38.4_1 - Light chain | SEQ ID NO: 88 |
| URS_1q!L1.31_24.6_2 - Light chain | SEQ ID NO: 89 |
| URS_1q!L1.31_19.3_1 - Light chain | SEQ ID NO: 90 |
| URS_1e!L1.30_15.3_2 - Light chain | SEQ ID NO: 91 |
| URS_1h!L1.30A_11.0_2 - Light chain | SEQ ID NO: 92 |
| URS_1h!L1.30_4.3_1 - Light chain | SEQ ID NO: 93 |

TABLE 1-continued

| Binder | SEQ ID NO |
| --- | --- |
| URS_1h!L1.30A_23.1_2 - Light chain | SEQ ID NO: 94 |
| URS_1.61_H1_26 - Light chain | SEQ ID NO: 95 |
| URS_1.63a_10_1 - Light chain | SEQ ID NO: 96 |
| URS_1.63a_22_1 - Light chain | SEQ ID NO: 97 |
| URS_1.63a_33_2 - Light chain | SEQ ID NO: 98 |
| URS_1c!L1.39_14.0_1 - Light chain | SEQ ID NO: 99 |
| URS_1c!L1.35_13.6_1 - Light chain | SEQ ID NO: 100 |
| URS_1c!L1.35_13.3_1 - Light chain | SEQ ID NO: 101 |
| URS_1.49_II_A3 - Light chain | SEQ ID NO: 102 |
| URS_1.49_II_A3 - heavy chain | SEQ ID NO: 103 |
| URS_1.49_I_D3 - Light chain | SEQ ID NO: 104 |
| URS_1.49_I_G8 - Light chain | SEQ ID NO: 105 |
| URS_1.49_I_G8 - heavy chain | SEQ ID NO: 106 |
| URS_1.49a_159_2 - Light chain | SEQ ID NO: 107 |
| URS_1.49a_56_2 - Light chain | SEQ ID NO: 108 |
| URS_1.49a_112_2 - Light chain | SEQ ID NO: 109 |
| URS_1.49a_92_2 - Light chain | SEQ ID NO: 110 |
| URS_1.49a_154_1 - Light chain | SEQ ID NO: 111 |
| URS_1k!L_1.22_11.3_1- Heavy chain | SEQ ID NO: 112 |
| URS_1k!L_1.22_11.3_1- Light chain | SEQ ID NO: 113 |
| URS_1.52a_160_2 - Light chain | SEQ ID NO: 114 |
| URS_1.50a_71_2 - Light chain | SEQ ID NO: 115 |
| URS_1m!L1.35_20.6_1 - Light chain | SEQ ID NO: 116 |
| URS_1m!L1.36_12.6_2 - Light chain | SEQ ID NO: 117 |
| URS_1m!L1.36_12.1_1 - Light chain | SEQ ID NO: 118 |
| URS_1q!L1.36_20.0_2 - Light chain | SEQ ID NO: 119 |
| URS_1.62a_112_2 | SEQ ID NO: 120 |
| URS_1c!L1.40_15.3_1 - Light chain | SEQ ID NO: 121 |
| URS_1c!L1.40_7.0_1 - Light chain | SEQ ID NO: 122 |
| URS_1c!L1.40_15.21_1 - Light chain | SEQ ID NO: 123 |
| URS_1c!L1.40_15.20_1 - Light chain | SEQ ID NO: 124 |
| URS_1c!L1.40_15.25_1 - Light chain | SEQ ID NO: 125 |
| URS_1c!L1.40_15.14_1 - Light chain | SEQ ID NO: 126 |
| URS_1c!L1.40_7.5_1 - Light chain | SEQ ID NO: 127 |
| URS_1.64a_65_1 - Light chain | SEQ ID NO: 128 |
| URS_1.57a_123_2 - Light chain | SEQ ID NO: 129 |
| URS_1.57a_68_1 - Light chain | SEQ ID NO: 130 |
| URS_1.57a_98_2 - Light chain | SEQ ID NO: 131 |
| URS_1.57a_116_2 - Light chain | SEQ ID NO: 132 |
| URS_1.57a_17_1 - Light chain | SEQ ID NO: 133 |
| URS_1.57a_56_2 - Light chain | SEQ ID NO: 134 |
| URS_N92I - Light chain | SEQ ID NO: 135 |
| URS_R93K - Light chain | SEQ ID NO: 136 |
| URS_R93Q - Light chain | SEQ ID NO: 137 |
| URS_R93M - Light chain | SEQ ID NO: 138 |
| URS_2.1a_12.5_1 - Heavy chain | SEQ ID NO: 139 |
| URS_2.1a_12.5_1 - Light chain | SEQ ID NO: 140 |
| URS_2.1a_6.2_1 - Heavy chain | SEQ ID NO: 141 |
| URS_2.1a_6.2_1 - Light chain | SEQ ID NO: 142 |
| URS_2.1a_8.1_1 - Heavy chain | SEQ ID NO: 143 |
| URS_2.1a_8.1_1 - Light chain | SEQ ID NO: 144 |
| URS_2.1a_12.7_1 - Heavy chain | SEQ ID NO: 145 |
| URS_2.1a_12.7_1 - Light chain | SEQ ID NO: 146 |
| URS_2.1b_9.0_1 - Heavy chain | SEQ ID NO: 147 |
| URS_2.1b_9.0_1 - Light chain | SEQ ID NO: 148 |
| URS_2.1b_9.0_1 - VH chain | SEQ ID NO: 149 |
| URS_2.1b_9.0_1 - VL chain | SEQ ID NO: 150 |
| URS_2.1b_5.5_1 - Heavy chain | SEQ ID NO: 151 |
| URS_2.1b_5.5_1 - Light chain | SEQ ID NO: 152 |
| URS_2.1b_13.5_1 - Heavy chain | SEQ ID NO: 153 |
| URS_2.1b_13.5_1 - Light chain | SEQ ID NO: 154 |
| URS_2.1b_25.6_1 - Heavy chain | SEQ ID NO: 155 |
| URS_2.1b_25.6_1 - Light chain | SEQ ID NO: 156 |
| URS_2.1b_9.2_1 - Heavy chain | SEQ ID NO: 157 |
| URS_2.1b_9.2_1 - Light chain | SEQ ID NO: 158 |
| URS_2.1b_6.4_2 - Heavy chain | SEQ ID NO: 159 |
| URS_2.1b_6.4_2 - Light chain | SEQ ID NO: 160 |
| URS_2.1c_33.7_1 - Heavy chain | SEQ ID NO: 161 |
| URS_2.1c_33.7_1 - Light chain | SEQ ID NO: 162 |
| URS_2.1c_32.1_1 - Heavy chain | SEQ ID NO: 163 |
| URS_2.1c_32.1_1 - Light chain | SEQ ID NO: 164 |
| URS_2.1c_33.3_1 - Heavy chain | SEQ ID NO: 165 |
| URS_2.1c_33.3_1 - Light chain | SEQ ID NO: 166 |
| URS_2.1c_31.0_1 - Heavy chain | SEQ ID NO: 167 |
| URS_2.1c_31.0_1 - Light chain | SEQ ID NO: 168 |
| URS_2.1c_34.2_1 - Heavy chain | SEQ ID NO: 169 |
| URS_2.1c_34.2_1 - Light chain | SEQ ID NO: 170 |
| URS_2.1c_34.5_1 - Heavy chain | SEQ ID NO: 171 |

TABLE 1-continued

| Binder | SEQ ID NO |
|---|---|
| URS_2.1c_34.5_1 - Light chain | SEQ ID NO: 172 |
| URS_2.1c_30.1_1 - Heavy chain | SEQ ID NO: 173 |
| URS_2.1c_30.1_1 - Light chain | SEQ ID NO: 174 |
| URS_2.1c_34.3_1 - Heavy chain | SEQ ID NO: 175 |
| URS_2.1c_34.3_1 - Light chain | SEQ ID NO: 176 |
| URS_2.1Amp_H2_13_20 - Heavy chain | SEQ ID NO: 177 |
| URS_2.1Amp_H2_13_20 - Light chain | SEQ ID NO: 178 |
| URS_2.1Amp_H3_16_26 - Heavy chain | SEQ ID NO: 179 |
| URS_2.1Amp_H3_16_26 - Light chain | SEQ ID NO: 180 |
| URS_2.1Amp_H3_20_27 - Heavy chain | SEQ ID NO: 181 |
| URS_2.1Amp_H3_20_27 - Light chain | SEQ ID NO: 182 |
| URS_2.1Amp_H3_5_22 - Heavy chain | SEQ ID NO: 183 |
| URS_2.1Amp_H3_5_22 - Light chain | SEQ ID NO: 184 |
| URS_2.1Amp_H3_4_87 - Heavy chain | SEQ ID NO: 185 |
| URS_2.1Amp_H3_4_87 - Light chain | SEQ ID NO: 186 |
| URS_2.1Amp_H2_3_72 - Heavy chain | SEQ ID NO: 187 |
| URS_2.1Amp_H2_3_72 - Light chain | SEQ ID NO: 188 |
| URS_2.1Amp_H2_11_88 - Heavy chain | SEQ ID NO: 189 |
| URS_2.1Amp_H2_11_88 - Light chain | SEQ ID NO: 190 |
| URS_2.1Amp_H3_6_21 - Heavy chain | SEQ ID NO: 191 |
| URS_2.1Amp_H3_6_21 - Light chain | SEQ ID NO: 192 |
| URS_2.1Amp_H3_15_27 - Heavy chain | SEQ ID NO: 193 |
| URS_2.1Amp_H3_15_27 - Light chain | SEQ ID NO: 194 |
| URS_2.1Amp_H2_17_58 - Heavy chain | SEQ ID NO: 195 |
| URS_2.1Amp_H2_17_58 - Light chain | SEQ ID NO: 196 |
| URS_2.1Amp_53 - Heavy chain | SEQ ID NO: 197 |
| URS_2.1Amp_53 - Light chain | SEQ ID NO: 198 |
| URS_2.1Amp_68 - Heavy chain | SEQ ID NO: 199 |
| URS_2.1Amp_68 - Light chain | SEQ ID NO: 200 |
| URS_2.1Amp_153 - Heavy chain | SEQ ID NO: 201 |
| URS_2.1Amp_153 - Light chain | SEQ ID NO: 202 |
| URS_1.66a_11_1 - Light chain | SEQ ID NO: 203 |
| URS_1.66a_25_1 - Light chain | SEQ ID NO: 204 |
| URS_1.66a_33_1 - Light chain | SEQ ID NO: 205 |
| URS_1.66a_43_1 - Light chain | SEQ ID NO: 206 |
| URS_1.66a_51_1 - Light chain | SEQ ID NO: 207 |
| URS_1.66a_133_1 - Light chain | SEQ ID NO: 208 |
| URS_1.67a_16 - Light chain | SEQ ID NO: 209 |
| URS_1.67a_76 - Heavy chain | SEQ ID NO: 210 |
| URS_1.67a_76 - Light chain | SEQ ID NO: 211 |
| URS_1.67a_80 - Light chain | SEQ ID NO: 212 |
| URS_1.67a_106 - Light chain | SEQ ID NO: 213 |
| URS_1.68a_41 - Heavy chain | SEQ ID NO: 214 |
| URS_1.68a_122 - Heavy chain | SEQ ID NO: 215 |
| URS_1.68a_154 - Heavy chain | SEQ ID NO: 216 |
| URS_2.1b_39.1_1 - Heavy chain | SEQ ID NO: 217 |
| URS_2.1b_39.1_1 - Light chain | SEQ ID NO: 218 |
| URS_2.1f_28.5_2 - Heavy chain | SEQ ID NO: 219 |
| URS_2.1f_28.5_2 - Light chain | SEQ ID NO: 220 |
| URS_2.1f_8.6_1 - Heavy chain | SEQ ID NO: 221 |
| URS_2.1f_8.6_1 - Light chain | SEQ ID NO: 222 |
| URS_2.2b_10.7_1 - Heavy chain | SEQ ID NO: 223 |
| URS_2.2b_10.7_1 - Light chain | SEQ ID NO: 224 |
| URS_2.2b_33.3_1 - Heavy chain | SEQ ID NO: 225 |
| URS_2.2b_33.3_1 - Light chain | SEQ ID NO: 226 |
| URS_2.2b_25.6_2 - Heavy chain | SEQ ID NO: 227 |
| URS_2.2b_25.6_2 - Light chain | SEQ ID NO: 228 |
| URS_2.2d_181 - Heavy chain | SEQ ID NO: 229 |
| URS_2.2d_181 - Light chain | SEQ ID NO: 230 |
| URS_2.2d_229 - Heavy chain | SEQ ID NO: 231 |
| URS_2.2d_229 - Light chain | SEQ ID NO: 232 |
| URS_2.2d_216 - Heavy chain | SEQ ID NO: 233 |
| URS_2.2d_216 - Light chain | SEQ ID NO: 234 |
| URS_2.2d_165 - Heavy chain | SEQ ID NO: 235 |
| URS_2.2d_165 - Light chain | SEQ ID NO: 236 |
| URS_2.2d_162 - Heavy chain | SEQ ID NO: 237 |
| URS_2.2d_162 - Light chain | SEQ ID NO: 238 |
| URS_2.2d_282 - Heavy chain | SEQ ID NO: 239 |
| URS_2.2d_282 - Light chain | SEQ ID NO: 240 |
| URS_2.2d_291 - Heavy chain | SEQ ID NO: 241 |
| URS_2.2d_291 - Light chain | SEQ ID NO: 242 |
| URS_2.2d_303 - Heavy chain | SEQ ID NO: 243 |
| URS_2.2d_303 - Light chain | SEQ ID NO: 244 |
| URS_2.2d_251 - Heavy chain | SEQ ID NO: 245 |
| URS_2.2d_251 - Light chain | SEQ ID NO: 246 |
| URS_2.2d_287 - Heavy chain | SEQ ID NO: 247 |
| URS_2.2d_287 - Light chain | SEQ ID NO: 248 |
| URS_2.2e_139 - Heavy chain | SEQ ID NO: 249 |
| URS_2.2e_139 - Light chain | SEQ ID NO: 250 |
| URS_2.2e_182 - Heavy chain | SEQ ID NO: 251 |
| URS_2.2e_182 - Light chain | SEQ ID NO: 252 |
| URS_2.2e_289 - Heavy chain | SEQ ID NO: 253 |
| URS_2.2e_289 - Light chain | SEQ ID NO: 254 |
| URS_2.2e_418 - Heavy chain | SEQ ID NO: 255 |
| URS_2.2e_418 - Light chain | SEQ ID NO: 256 |
| URS_3.1a_18.4_1 - Heavy chain | SEQ ID NO: 257 |
| URS_3.1a_18.4_1 - Light chain | SEQ ID NO: 258 |
| URS_3.1a_20.0_1 - Heavy chain | SEQ ID NO: 259 |
| URS_3.1a_20.0_1 - Light chain | SEQ ID NO: 260 |
| URS_3.1a_33.0_2 - Heavy chain | SEQ ID NO: 261 |
| URS_3.1a_33.0_2 - Light chain | SEQ ID NO: 262 |
| URS_3.1a_34.7_1 - Heavy chain | SEQ ID NO: 263 |
| URS_3.1a_34.7_1 - Light chain | SEQ ID NO: 264 |
| URS_3.1a_34.7_1 - VH chain | SEQ ID NO: 265 |
| URS_3.1a_34.7_1 - VL chain | SEQ ID NO: 266 |
| URS_3.1c_9.6_2 - Heavy chain | SEQ ID NO: 267 |
| URS_3.1c_9.6_2 - Light chain | SEQ ID NO: 268 |
| URS_3.1d_6.1_2 - Heavy chain | SEQ ID NO: 269 |
| URS_3.1d_6.1_2 - Light chain | SEQ ID NO: 270 |
| URS_3.1d_6.1_2 - VH chain | SEQ ID NO: 271 |
| URS_3.1d_6.1_2 - VL chain | SEQ ID NO: 272 |
| URS_3.1d_12.7_2 - Heavy chain | SEQ ID NO: 273 |
| URS_3.1d_12.7_2 - Light chain | SEQ ID NO: 274 |
| URS_3.1d_32.0_1 - Heavy chain | SEQ ID NO: 275 |
| URS_3.1d_32.0_1 - Light chain | SEQ ID NO: 276 |
| URS_3.1d_13.6_2 - Heavy chain | SEQ ID NO: 277 |
| URS_3.1d_13.6_2 - Light chain | SEQ ID NO: 278 |
| URS_3.1d_13.5_1 - Heavy chain | SEQ ID NO: 279 |
| URS_3.1d_13.5_1 - Light chain | SEQ ID NO: 280 |
| URS_3.1d_32.0_2 - Heavy chain | SEQ ID NO: 281 |
| URS_3.1d_32.0_2 - Light chain | SEQ ID NO: 282 |
| URS_3.1e_20.1_1 - Heavy chain | SEQ ID NO: 283 |
| URS_3.1e_20.1_1 - Light chain | SEQ ID NO: 284 |
| URS_3.1e_18.7_1 - Heavy chain | SEQ ID NO: 285 |
| URS_3.1e_18.7_1 - Light chain | SEQ ID NO: 286 |
| URS_3.1e_23.5_1 - Heavy chain | SEQ ID NO: 287 |
| URS_3.1e_23.5_1 - Light chain | SEQ ID NO: 288 |
| URS_3.1f_12.1_1 - Heavy chain | SEQ ID NO: 289 |
| URS_3.1f_12.1_1 - Light chain | SEQ ID NO: 290 |
| URS_3.1f_12.1_1 - VH chain | SEQ ID NO: 291 |
| URS_3.1f_12.1_1 - VL chain | SEQ ID NO: 292 |
| URS_3.1f_18.3_1 - Heavy chain | SEQ ID NO: 293 |
| URS_3.1f_18.3_1 - Light chain | SEQ ID NO: 294 |
| URS_3.1f_18.3_1 - VH chain | SEQ ID NO: 295 |
| URS_3.1f_18.3_1 - VL chain | SEQ ID NO: 296 |
| URS_3.1h_17.4_1 - Heavy chain | SEQ ID NO: 297 |
| URS_3.1h_17.4_1 - Light chain | SEQ ID NO: 298 |
| URS_3.1h_22.0_1 - Heavy chain | SEQ ID NO: 299 |
| URS_3.1h_22.0_1 - Light chain | SEQ ID NO: 300 |
| URS_4.2a_6 - Heavy chain | SEQ ID NO: 301 |
| URS_4.2a_6 - Light chain | SEQ ID NO: 302 |
| URS_4.2a_6 - VH chain | SEQ ID NO: 303 |
| URS_4.2a_6 - VL chain | SEQ ID NO: 304 |
| URS_4.1a_49 - Heavy chain | SEQ ID NO: 305 |
| URS_4.1a_49 - Light chain | SEQ ID NO: 306 |
| URS_4.2a_52 - Heavy chain | SEQ ID NO: 307 |
| URS_4.2a_52 - Light chain | SEQ ID NO: 308 |
| URS_4.2a_52 - VH chain | SEQ ID NO: 309 |
| URS_4.2a_52 - VL chain | SEQ ID NO: 310 |
| URS_4.2a_54 - Heavy chain | SEQ ID NO: 311 |
| URS_4.2a_54 - Light chain | SEQ ID NO: 312 |
| URS_4.2a_54 - VH chain | SEQ ID NO: 313 |
| URS_4.2a_54 - VL chain | SEQ ID NO: 314 |
| URS_4.2a_14 - Heavy chain | SEQ ID NO: 315 |
| URS_4.2a_14 - Light chain | SEQ ID NO: 316 |
| URS_4.2a_19 - Heavy chain | SEQ ID NO: 317 |
| URS_4.2a_19 - Light chain | SEQ ID NO: 318 |
| URS_2.8a_10.1_1 - Heavy chain | SEQ ID NO: 319 |
| URS_2.8a_10.1_1 - Light chain | SEQ ID NO: 320 |
| URS_2.8a_10.1_1 - VH chain | SEQ ID NO: 321 |
| URS_2.8a_10.1_1 - VL chain | SEQ ID NO: 322 |
| URS_2.8a_3.2_1 - Heavy chain | SEQ ID NO: 323 |
| URS_2.8a_3.2_1 - Light chain | SEQ ID NO: 324 |
| URS_2.8a_26.7_1 - Heavy chain | SEQ ID NO: 325 |
| URS_2.8a_26.7_1 - Light chain | SEQ ID NO: 326 |
| URS_2.8a_20.5_1 - Heavy chain | SEQ ID NO: 327 |

TABLE 1-continued

| Binder | SEQ ID NO |
|---|---|
| URS_2.8a_20.5_1 - Light chain | SEQ ID NO: 328 |
| URS_2.8a_34.6_1 - Heavy chain | SEQ ID NO: 329 |
| URS_2.8a_34.6_1 - Light chain | SEQ ID NO: 330 |
| URS_2.8a_30.7_1 - Heavy chain | SEQ ID NO: 331 |
| URS_2.8a_30.7_1 - Light chain | SEQ ID NO: 332 |
| URS_2.8a_4.5_1 - Heavy chain | SEQ ID NO: 333 |
| URS_2.8a_4.5_1 - Light chain | SEQ ID NO: 334 |
| URS_2.8a_5.5_1 - Heavy chain | SEQ ID NO: 335 |
| URS_2.8a_5.5_1 - Light chain | SEQ ID NO: 336 |
| URS_2.8b_17.3_1 - Heavy chain | SEQ ID NO: 337 |
| URS_2.8b_17.3_1 - Light chain | SEQ ID NO: 338 |
| URS_2.8b_13.0_1 - Heavy chain | SEQ ID NO: 339 |
| URS_2.8b_13.0_1 - Light chain | SEQ ID NO: 340 |
| URS_2.8a_30.1_1 - Heavy chain | SEQ ID NO: 341 |
| URS_2.8a_30.1_1 - Light chain | SEQ ID NO: 342 |
| URS_2.8a_50.1_1 - Heavy chain | SEQ ID NO: 343 |
| URS_2.8a_50.1_1 - Light chain | SEQ ID NO: 344 |
| URS_2.8a_15.1_1 - Heavy chain | SEQ ID NO: 345 |
| URS_2.8a_15.1_1 - Light chain | SEQ ID NO: 346 |
| URS_2.8b_15.7_1 - Heavy chain | SEQ ID NO: 347 |
| URS_2.8b_15.7_1 - Light chain | SEQ ID NO: 348 |
| URS_2.8a_16.2_1 - Heavy chain | SEQ ID NO: 349 |
| URS_2.8a_16.2_1 - Light chain | SEQ ID NO: 350 |
| URS_2.8a_11.3_1 - Heavy chain | SEQ ID NO: 351 |
| URS_2.8a_11.3_1 - Light chain | SEQ ID NO: 352 |
| URS_2.8b_6.0_1 - Heavy chain | SEQ ID NO: 353 |
| URS_2.8b_6.0_1 - Light chain | SEQ ID NO: 354 |
| URS_2.8b_28.6_1 - Heavy chain | SEQ ID NO: 355 |
| URS_2.8b_28.6_1 - Light chain | SEQ ID NO: 356 |
| URS_2.8b_6.0_2- Heavy chain | SEQ ID NO: 357 |
| URS_2.8b_6.0_2 - Light chain | SEQ ID NO: 358 |
| URS_2.8b_6.0_2- VH chain | SEQ ID NO: 359 |
| URS_2.8b_6.0_2 - VL chain | SEQ ID NO: 360 |
| URS_2.8a_10.0_1 - Heavy chain | SEQ ID NO: 361 |
| URS_2.8a_10.0_1 - Light chain | SEQ ID NO: 362 |
| URS_2.8a_35.5_1 - Heavy chain | SEQ ID NO: 363 |
| URS_2.8a_35.5_1 - Light chain | SEQ ID NO: 364 |
| URS_2.4a_21.4_1 - Heavy chain | SEQ ID NO: 365 |
| URS_2.4a_21.4_1 - Light chain | SEQ ID NO: 366 |
| URS_2.4a_32.1_1 - Heavy chain | SEQ ID NO: 367 |
| URS_2.4a_32.1_1 - Light chain | SEQ ID NO: 368 |
| URS_2.4a_32.5_1 - Heavy chain | SEQ ID NO: 369 |
| URS_2.4a_32.5_1 - Light chain | SEQ ID NO: 370 |
| URS_2.4a_37.7_1 - Heavy chain | SEQ ID NO: 371 |
| URS_2.4a_37.7_1 - Light chain | SEQ ID NO: 372 |
| URS_2.4a_13.0_1 - Heavy chain | SEQ ID NO: 373 |
| URS_2.4a_13.0_1 - Light chain | SEQ ID NO: 374 |
| URS_2.4a_13.0_1 - Heavy chain | SEQ ID NO: 375 |
| URS_2.4a_13.0_1 - Light chain | SEQ ID NO: 376 |
| URS_2.7b_20.3_1 - Heavy chain | SEQ ID NO: 377 |
| URS_2.7b_20.3_1 - Light chain | SEQ ID NO: 378 |
| URS_2.4a_21.2_1 - Heavy chain | SEQ ID NO: 379 |
| URS_2.4a_21.2_1 - Light chain | SEQ ID NO: 380 |
| URS_2.7b_7.0_1 - Heavy chain | SEQ ID NO: 381 |
| URS_2.7b_7.0_1 - Light chain | SEQ ID NO: 382 |
| URS_2.7c_18.0_1 - Heavy chain | SEQ ID NO: 383 |
| URS_2.7c_18.0_1 - Light chain | SEQ ID NO: 384 |
| URS_2.4a_32.4_1 - Heavy chain | SEQ ID NO: 385 |
| URS_2.4a_32.4_1 - Light chain | SEQ ID NO: 386 |
| URS_2.4a_40.0_1 - Heavy chain | SEQ ID NO: 387 |
| URS_2.4a_40.0_1 - Light chain | SEQ ID NO: 388 |
| URS_2.4a_42.0_1 - Heavy chain | SEQ ID NO: 389 |
| URS_2.4a_42.0_1 - Light chain | SEQ ID NO: 390 |
| URS_2.7b_32.1_1 - Heavy chain | SEQ ID NO: 391 |
| URS_2.7b_32.1_1 - Light chain | SEQ ID NO: 392 |
| URS_2.7b_40.2_1 - Heavy chain | SEQ ID NO: 393 |
| URS_2.7b_40.2_1 - Light chain | SEQ ID NO: 394 |
| URS_2.7c_4.5_1 - Heavy chain | SEQ ID NO: 395 |
| URS_2.7c_4.5_1 - Light chain | SEQ ID NO: 396 |
| URS_2.7b_30.7_1 - Heavy chain | SEQ ID NO: 397 |
| URS_2.7b_30.7_1 - Light chain | SEQ ID NO: 398 |
| URS_2.4a_21.2_2 - Heavy chain | SEQ ID NO: 399 |
| URS_2.4a_21.2_2 - Light chain | SEQ ID NO: 400 |
| URS_2.4a_21.2_2 - VH chain | SEQ ID NO: 401 |
| URS_2.4a_21.2_2 - VH chain | SEQ ID NO: 402 |
| URS_2.7c_4.4_1 - Heavy chain | SEQ ID NO: 403 |
| URS_2.7c_4.4_1 - Light chain | SEQ ID NO: 404 |
| URS_2.7b_39.4_1 - Heavy chain | SEQ ID NO: 405 |
| URS_2.7b_39.4_1 - Light chain | SEQ ID NO: 406 |
| URS_2.7a_28.1_1 - Heavy chain | SEQ ID NO: 407 |
| URS_2.7a_28.1_1 - Light chain | SEQ ID NO: 408 |
| URS_2.7c_5.5_1 - Heavy chain | SEQ ID NO: 409 |
| URS_2.7c_5.5_1 - Light chain | SEQ ID NO: 410 |
| URS_2.4a_13.3_1 - Heavy chain | SEQ ID NO: 411 |
| URS_2.4a_13.3_1 - Light chain | SEQ ID NO: 412 |
| URS_2.7c_10.6_2 - Heavy chain | SEQ ID NO: 413 |
| URS_2.7c_10.6_2 - Light chain | SEQ ID NO: 414 |
| URS_2.7b_12.1_1 - Heavy chain | SEQ ID NO: 415 |
| URS_2.7b_12.1_1 - Light chain | SEQ ID NO: 416 |
| URS_2.7c_6.5_1 - Heavy chain | SEQ ID NO: 417 |
| URS_2.7c_6.5_1 - Light chain | SEQ ID NO: 418 |
| URS_2.4a_29.6_1 - Heavy chain | SEQ ID NO: 419 |
| URS_2.4a_29.6_1 - Light chain | SEQ ID NO: 420 |
| URS_2.7a_9.3_1 - Heavy chain | SEQ ID NO: 421 |
| URS_2.7a_9.3_1 - Light chain | SEQ ID NO: 422 |
| URS_2.7b_9.4_1 - Heavy chain | SEQ ID NO: 423 |
| URS_2.7b_9.4_1 - Light chain | SEQ ID NO: 424 |
| URS_2.7b_6.5_1 - Heavy chain | SEQ ID NO: 425 |
| URS_2.7b_6.5_1 - Light chain | SEQ ID NO: 426 |
| URS_2.7c_7.4_1 - Heavy chain | SEQ ID NO: 427 |
| URS_2.7c_7.4_1 - Light chain | SEQ ID NO: 428 |
| URS_2.7c_4.1_1 - Heavy chain | SEQ ID NO: 429 |
| URS_2.7c_4.1_1 - Light chain | SEQ ID NO: 430 |
| URS_2.7c_5.4_1 - Heavy chain | SEQ ID NO: 431 |
| URS_2.7c_5.4_1 - Light chain | SEQ ID NO: 432 |
| URS_2.7b_33.6_1 - Heavy chain | SEQ ID NO: 433 |
| URS_2.7b_33.6_1 - Light chain | SEQ ID NO: 434 |
| URS_2.7c_13.3_1 - Heavy chain | SEQ ID NO: 435 |
| URS_2.7c_13.3_1 - Light chain | SEQ ID NO: 436 |
| URS_2.4a_33.7_1 - Heavy chain | SEQ ID NO: 437 |
| URS_2.4a_33.7_1 - Light chain | SEQ ID NO: 438 |
| URS_2.4a_41.6_1 - Heavy chain | SEQ ID NO: 439 |
| URS_2.4a_41.6_1 - Light chain | SEQ ID NO: 440 |
| URS_2.7a_28.2_1 - Heavy chain | SEQ ID NO: 441 |
| URS_2.7a_28.2_1 - Light chain | SEQ ID NO: 442 |
| URS_2.7a_28.3_1 - Heavy chain | SEQ ID NO: 443 |
| URS_2.7a_28.3_1 - Light chain | SEQ ID NO: 444 |
| URS_2.7c_5.7_1 - Heavy chain | SEQ ID NO: 445 |
| URS_2.7c_5.7_1 - Light chain | SEQ ID NO: 446 |
| URS_2.7a_7.2_1 - Heavy chain | SEQ ID NO: 447 |
| URS_2.7a_7.2_1 - Light chain | SEQ ID NO: 448 |
| URS_2.7b_13.5_1 - Heavy chain | SEQ ID NO: 449 |
| URS_2.7b_13.5_1 - Light chain | SEQ ID NO: 450 |
| URS_4.2a_26 heavy chain | SEQ ID NO: 451 |
| URS_4.2a_26 light chain | SEQ ID NO: 452 |
| URS_4.2a_26 VH chain | SEQ ID NO: 453 |
| URS_4.2a_26 VL chain | SEQ ID NO: 454 |
| Humira-Fab - Heavy chain | SEQ ID NO: 455 |
| Humira-Fab - Light chain | SEQ ID NO: 456 |
| Full length_URS_2.1b_9.0_1 - Heavy chain | SEQ ID NO: 457 |
| Full length_URS_2.1b_9.0_1 - Light chain | SEQ ID NO: 458 |
| Full length_URS_2.1_H2_3_72 - Heavy chain | SEQ ID NO: 459 |
| Full length_URS_2.1_H2_3_72 - Light chain | SEQ ID NO: 460 |
| Full length_HUMIRA - Heavy chain | SEQ ID NO: 461 |
| Full length_HUMIRA - Light chain | SEQ ID NO: 462 |
| Fab - cb1-3 Heavy chain | SEQ ID NO: 463 |
| Fab - cb1-3 light chain | SEQ ID NO: 464 |

The invention may be embodied in other specific forms without departing from the spirit or essential characteristics thereof. The foregoing embodiments are therefore to be considered in all respects illustrative rather than limiting on the invention described herein. Scope of the invention is thus indicated by the appended claims rather than by the foregoing description, and all changes which come within the meaning and range of equivalency of the claims are therefore intended to be embraced therein.

SEQUENCE LISTING (516 sequences)

SEQ ID NO: 1 - protein, 224 aa, Artificial Sequence
  D2E7 heavy chain
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 2 - protein, 214 aa, Artificial Sequence
  D2E7 light chain
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3 - DNA, 672 bp, Artificial Sequence
  D2E7 heavy chain
gaagttcagctggttgaaagcggcggtggtctggttcagccgggtcgtagcctgcgtctgagctgtgcggcgagcggctttacctttgatgattatgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 4 - DNA, 642 bp, Artificial Sequence
  D2E7 light chain
gatattcagatgacccagagcccgagcagcctgagcgcgagcgtgggcgatcgtgtgaccattacctgccgtgcgagccagggcattcgtaactatctggcctggtatcagcagaaaccgggcaaagcgccgaaactgctgatttatgcggcgagcaccctgcagagcggtgtgccgagccgttttagcggcagcggtagcggcaccgattttaccctgaccattagcagcctgcagccggaagatgtggcgacctattattgccagcgttataaccgtgcgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 5 - protein, 224 aa, Artificial Sequence
  modified heavy chain
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (32)..(32): X = Y, F, R, Q or S
  VARIANT (34)..(34): X = M or I
  VARIANT (39)..(39): X = Q or R
  VARIANT (40)..(40): X = A or V
  VARIANT (50)..(50): X = A or G
  VARIANT (58)..(58): X = I, V or T
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
  VARIANT (124)..(124): X = T or A
  VARIANT (145)..(145): X = A or V
  VARIANT (167)..(167): X = L or P
  VARIANT (200)..(200): X = Q or K
  VARIANT (219)..(219): X = V or M
  VARIANT (220)..(220): X = E or G
XVXLXESGGGLVXPGXSLRLSCXXSGFXFXXXAXHWVRXXPGKGLEWVSXITWNSGHXDYADSVXXRFTISRDNAKNSLYLQMNSLRAEDTAVYYCAKVXYLXTASXLDYWGQGTLVTVSSASXKGPSVFPLAPSSKSTSGGTAXLGCLVKDYFPEPVTVSWNSGAXTSGVHTFPAVLQSSGLYSLSSVVTVPSSSLGTXTYICNVNHKPSNTKVDKKXXPKSC

SEQ ID NO: 6 - protein, 224 aa, Artificial Sequence; identical to SEQ ID NO: 5
  modified heavy chain
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (32)..(32): X = F, R or Q
  VARIANT (34)..(34): X = M or I
  VARIANT (39)..(39): X = Q or R
  VARIANT (40)..(40): X = A or V
  VARIANT (50)..(50): X = A or G
  VARIANT (58)..(58): X = I, V or T
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
  VARIANT (124)..(124): X = T or A
  VARIANT (145)..(145): X = A or V
  VARIANT (167)..(167): X = L or P
  VARIANT (200)..(200): X = Q or K
  VARIANT (219)..(219): X = V or M
  VARIANT (220)..(220): X = E or G

SEQ ID NO: 7 - protein, 224 aa, Artificial Sequence
  modified heavy chain
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (34)..(34): X = M or I
  VARIANT (39)..(39): X = Q or R
  VARIANT (40)..(40): X = A or V
  VARIANT (50)..(50): X = A or G
  VARIANT (58)..(58): X = I, V or T
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
  VARIANT (124)..(124): X = T or A
  VARIANT (145)..(145): X = A or V
  VARIANT (167)..(167): X = L or P
  VARIANT (200)..(200): X = Q or K
  VARIANT (219)..(219): X = V or M
  VARIANT (220)..(220): X = E or G
XVXLXESGGGLVXPGXSLRLSCXXSGFXFXXFAXHWVRXXPGKGLEWVSXITWNSGHXDYADSVXXRFTISRDNAKNSLYLQMNSLRAEDTAVYYCAKVXYLXTASXLDYWGQGTLVTVSSASXKGPSVFPLAPSSKSTSGGTAXLGCLVKDYFPEPVTVSWNSGAXTSGVHTFPAVLQSSGLYSLSSVVTVPSSSLGTXTYICNVNHKPSNTKVDKKXXPKSC

SEQ ID NO: 8 - protein, 224 aa, Artificial Sequence
  modified heavy chain
  VARIANT (13)..(13): X = Q or H
  VARIANT (30)..(30): X = D or G
  VARIANT (100)..(100): X = S or K
  VARIANT (103)..(103): X = S or P
EVQLVESGGGLVXPGRSLRLSCAASGFTFXQFAMHWVRQAPGKGLEWVSAITWNSGHIDYADSVEGRFTISRDNAKNSLYLQMNSLRAEDTAVYYCAKVXYLXTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 9 - protein, 224 aa, Artificial Sequence
  modified heavy chain
  VARIANT (13)..(13): X = Q or H
  VARIANT (100)..(100): X = S or K
  VARIANT (103)..(103): X = S or P
EVQLVESGGGLVXPGRSLRLSCAASGFTFGQFAMHWVRQAPGKGLEWVSAITWNSGHIDYADSVEGRFTISRDNAKNSLYLQMNSLRAEDTAVYYCAKVXYLXTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 10 - protein, 224 aa, Artificial Sequence
  modified heavy chain
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (32)..(32): X = Y, F, R, Q or S
  VARIANT (34)..(34): X = M or I
  VARIANT (39)..(39): X = Q or R
  VARIANT (40)..(40): X = A or V
  VARIANT (50)..(50): X = A or G
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
  VARIANT (124)..(124): X = T or A
  VARIANT (145)..(145): X = A or V
  VARIANT (167)..(167): X = L or P
  VARIANT (200)..(200): X = Q or K
  VARIANT (219)..(219): X = V or M
  VARIANT (220)..(220): X = E or G
XVXLXESGGGLVXPGXSLRLSCXXSGFXFXXXAXHWVRXXPGKGLEWVSXITWNSGHVDYADSVXXRFTISRDNAKNSLYLQMNSLRAEDTAVYYCAKVXYLXTASXLDYWGQGTLVTVSSASXKGPSVFPLAPSSKSTSGGTAXLGCLVKDYFPEPVTVSWNSGAXTSGVHTFPAVLQSSGLYSLSSVVTVPSSSLGTXTYICNVNHKPSNTKVDKKXXPKSC

SEQ ID NO: 11 - protein, 224 aa, Artificial Sequence
  modified heavy chain
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (31)..(31): X = D,H, Q, G, T, N or R
  VARIANT (32)..(32): X = Y, F, R, Q or S
  VARIANT (34)..(34): X = M or I
  VARIANT (39)..(39): X = Q or R
  VARIANT (40)..(40): X = A or V
  VARIANT (50)..(50): X = A or G
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
  VARIANT (124)..(124): X = T or A
  VARIANT (145)..(145): X = A or V
  VARIANT (167)..(167): X = L or P
  VARIANT (200)..(200): X = Q or K
  VARIANT (219)..(219): X = V or M
  VARIANT (220)..(220): X = E or G
XVXLXESGGGLVXPGXSLRLSCXXSGFXFGXXAXHWVRXXPGKGLEWVSXITWNSGHVDYADSVXXRFTISRDNAKNSLYLQMNSLRAEDTAVYYCAKVXYLXTASXLDYWGQGTLVTVSSASXKGPSVFPLAPSSKSTSGGTAXLGCLVKDYFPEPVTVSWNSGAXTSGVHTFPAVLQSSGLYSLSSVVTVPSSSLGTXTYICNVNHKPSNTKVDKKXXPKSC

SEQ ID NO: 12 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXXXXRNYLAWYQQKPXKAPKLLIXAAXXXXXXXPSRFSGSGSGTDFTLTISSXQXEDVATYYCQRYXXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 13 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXXXXRNYLAWYQQKPXKAPKLLIXAAXSTXXXXPSRFSGSGSGTDFTLTISSXQXEDVATYYCQRYXXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 14 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXXXXRNYLAWYQQKPXKAPKLLIXAAXSXXXXXPSRFSGSGSGTDFTLTISSXQXEDVATYYCQRYXXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 15 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXXXXRNYLAWYQQKPXKAPKLLIXAAXWXXXXXPSRFSGSGSGTDFTLTISSXQXEDVATYYCQRYXXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 16 - protein, 214 aa, Artificial Sequence; identical to SEQ ID NO: 12
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G

SEQ ID NO: 17 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXXXXRNYLAWYQQKPXKAPKLLIXAAXXTXXXXPSRFSGSGSGTDFTLTISSXQXEDVATYYCQRYXXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 18 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXMXXRNYLAWYQQKPXKAPKLLIXAAXXXXXXXPSRFSGSGSGTDFTLTISSXQXEDVATYYCQRYXXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 19 - protein, 214 aa, Artificial Sequence
  modified light chain
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
  VARIANT (129)..(129): X = T or A
  VARIANT (136)..(136): X = L or P
  VARIANT (144)..(144): X = A or S
  VARIANT (161)..(161): X = E or D
  VARIANT (166)..(166): X = Q or R
  VARIANT (180)..(180): X = T or I
  VARIANT (196)..(196): X = V or A
  VARIANT (197)..(197): X = T or A
  VARIANT (212)..(212): X = G or V
  VARIANT (214)..(214): X = C or G
XIQMXQSPSSLSASXGDRVTITCXXXXXXRNYLAWYQQKPXKAPKLLIXAAXXXXXXXPSRFSGSGSGTDFTLTISSXQXEDVATYYCQRYIXXXYTFGQGTKXEIKRTVAAPSVFIFPPSDEQLKSGXASVVCLXNNFYPREXKVQWKVDNALQSGNSQXSVTEXDSKDSTYSLSSTLXLSKADYEKHKVYACEXXHQGLSSPVTKSFNRXEX

SEQ ID NO: 20 - protein, 120 aa, Artificial Sequence
  modified heavy chain VH
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (32)..(32): X = Y, F, R, Q or S
  VARIANT (34)..(34): X = M or I
  VARIANT (39)..(39): X = Q or R
  VARIANT (40)..(40): X = A or V
  VARIANT (50)..(50): X = A or G
  VARIANT (58)..(58): X = I, V or T
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
XVXLXESGGGLVXPGXSLRLSCXXSGFXFXXXAXHWVRXXPGKGLEWVSXITWNSGHXDYADSVXXRFTISRDNAKNSLYLQMNSLRAEDTAVYYCAKVXYLXTASXLDYWGQGTLVTVS

SEQ ID NO: 21 - protein, 120 aa, Artificial Sequence; identical to SEQ ID NO: 20
  modified heavy chain VH
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (32)..(32): X = F, R or Q
  VARIANT (34)..(34): X = M or I
  VARIANT (39)..(39): X = Q or R
  VARIANT (40)..(40): X = A or V
  VARIANT (50)..(50): X = A or G
  VARIANT (58)..(58): X = I, V or T
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q

SEQ ID NO: 22 - protein, 120 aa, Artificial Sequence
  modified heavy chain VH
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (34)..(34): X = M or I
  VARIANT (39)..(39): X = Q or R
  VARIANT (40)..(40): X = A or V
  VARIANT (50)..(50): X = A or G
  VARIANT (58)..(58): X = I, V or T
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
XVXLXESGGGLVXPGXSLRLSCXXSGFXFXXFAXHWVRXXPGKGLEWVSXITWNSGHXDYADSVXXRFTISRDNAKNSLYLQMNSLRAEDTAVYYCAKVXYLXTASXLDYWGQGTLVTVS

SEQ ID NO: 23 - protein, 120 aa, Artificial Sequence
  modified heavy chain VH
  VARIANT (13)..(13): X = Q or H
  VARIANT (30)..(30): X = D or G
  VARIANT (100)..(100): X = S or K
  VARIANT (103)..(103): X = S or P
EVQLVESGGGLVXPGRSLRLSCAASGFTFXQFAMHWVRQAPGKGLEWVSAITWNSGHIDYADSVEGRFTISRDNAKNSLYLQMNSLRAEDTAVYYCAKVXYLXTASSLDYWGQGTLVTVS

SEQ ID NO: 24 - protein, 120 aa, Artificial Sequence
  modified heavy chain VH
  VARIANT (13)..(13): X = Q or H
  VARIANT (100)..(100): X = S or K
  VARIANT (103)..(103): X = S or P
EVQLVESGGGLVXPGRSLRLSCAASGFTFGQFAMHWVRQAPGKGLEWVSAITWNSGHIDYADSVEGRFTISRDNAKNSLYLQMNSLRAEDTAVYYCAKVXYLXTASSLDYWGQGTLVTVS

SEQ ID NO: 25 - protein, 120 aa, Artificial Sequence
  modified heavy chain VH
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (30)..(30): X = D, G or R
  VARIANT (31)..(31): X = D,H, Q, G, T, N or R
  VARIANT (32)..(32): X = Y, F, R, Q or S
  VARIANT (34)..(34): X = M or I
  VARIANT (39)..(39): X = Q or R
  VARIANT (40)..(40): X = A or V
  VARIANT (50)..(50): X = A or G
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
XVXLXESGGGLVXPGXSLRLSCXXSGFXFXXXAXHWVRXXPGKGLEWVSXITWNSGHVDYADSVXXRFTISRDNAKNSLYLQMNSLRAEDTAVYYCAKVXYLXTASXLDYWGQGTLVTVS

SEQ ID NO: 26 - protein, 120 aa, Artificial Sequence
  modified heavy chain VH
  VARIANT (1)..(1): X= E or K
  VARIANT (3)..(3): X = Q or R
  VARIANT (5)..(5): X = V or I
  VARIANT (13)..(13): X = Q or H
  VARIANT (16)..(16): X = R or H
  VARIANT (23)..(23): X = A, V or T
  VARIANT (24)..(24): X = A or S
  VARIANT (28)..(28): X = T or S
  VARIANT (31)..(31): X = D,H, Q, G, T, N or R
  VARIANT (32)..(32): X = Y, F, R, Q or S
  VARIANT (34)..(34): X = M or I
  VARIANT (39)..(39): X = Q or R
  VARIANT (40)..(40): X = A or V
  VARIANT (50)..(50): X = A or G
  VARIANT (65)..(65): X = E or R
  VARIANT (66)..(66): X = G or N
  VARIANT (100)..(100): X = S or K
  VARIANT (103)..(103): X = S, Q or P
  VARIANT (107)..(107): X = S or Q
XVXLXESGGGLVXPGXSLRLSCXXSGFXFGXXAXHWVRXXPGKGLEWVSXITWNSGHVDYADSVXXRFTISRDNAKNSLYLQMNSLRAEDTAVYYCAKVXYLXTASXLDYWGQGTLVTVS

SEQ ID NO: 27 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXXXXRNYLAWYQQKPXKAPKLLIXAAXXXXXXXPSRFSGSGSGTDFTLTISSXQXEDVATYYCQRYXXXXYTFGQGTKXEIK

SEQ ID NO: 28 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXXXXRNYLAWYQQKPXKAPKLLIXAAXSTXXXXPSRFSGSGSGTDFTLTISSXQXEDVATYYCQRYXXXXYTFGQGTKXEIK

SEQ ID NO: 29 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXXXXRNYLAWYQQKPXKAPKLLIXAAXSXXXXXPSRFSGSGSGTDFTLTISSXQXEDVATYYCQRYXXXXYTFGQGTKXEIK

SEQ ID NO: 30 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXXXXRNYLAWYQQKPXKAPKLLIXAAXWXXXXXPSRFSGSGSGTDFTLTISSXQXEDVATYYCQRYXXXXYTFGQGTKXEIK

SEQ ID NO: 31 - protein, 107 aa, Artificial Sequence; identical to SEQ ID NO: 27
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I

SEQ ID NO: 32 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXXXXRNYLAWYQQKPXKAPKLLIXAAXXTXXXXPSRFSGSGSGTDFTLTISSXQXEDVATYYCQRYXXXXYTFGQGTKXEIK

SEQ ID NO: 33 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (92)..(92): X = N, D or I
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXMXXRNYLAWYQQKPXKAPKLLIXAAXXXXXXXPSRFSGSGSGTDFTLTISSXQXEDVATYYCQRYXXXXYTFGQGTKXEIK

SEQ ID NO: 34 - protein, 107 aa, Artificial Sequence
  modified light chain VL
  VARIANT (1)..(1): X = D or N
  VARIANT (5)..(5): X = T or S
  VARIANT (15)..(15): X = V or M
  VARIANT (24)..(24): X = R, H, T, L or A
  VARIANT (25)..(25): X = A, T, S or G
  VARIANT (26)..(26): X = S or T
  VARIANT (27)..(27): X = Q, M, L, Y, V, W or K
  VARIANT (28)..(28): X = G, R, S, D, P or L
  VARIANT (29)..(29): X = I, V or L
  VARIANT (41)..(41): X = G or S
  VARIANT (49)..(49): X = Y, R, V, W, G or S
  VARIANT (52)..(52): X = S, G, N or W
  VARIANT (53)..(53): X = T, W, S, Y, G or V
  VARIANT (54)..(54): X = L, F, T or S
  VARIANT (55)..(55): X = Q, K, I, E, G, V, T, R, S or L
  VARIANT (56)..(56): X = S, K or R
  VARIANT (57)..(57): X = G or S
  VARIANT (58)..(58): X = V or M
  VARIANT (78)..(78): X = L or P
  VARIANT (80)..(80): X = P or Q
  VARIANT (93)..(93): X = R, Q, K or M
  VARIANT (94)..(94): X = A, P or S
  VARIANT (95)..(95): X = P, F, Q, A, S, M, E or V
  VARIANT (104)..(104): X = V or I
XIQMXQSPSSLSASXGDRVTITCXXXXXXRNYLAWYQQKPXKAPKLLIXAAXXXXXXXPSRFSGSGSGTDFTLTISSXQXEDVATYYCQRYIXXXYTFGQGTKXEIK

SEQ ID NO: 35 - protein, 214 aa, Artificial Sequence
  modified light chain
  VARIANT (24)..(24): X = R, H, T, L or A
  VARIANT (49)..(49): X = Y, R, V, W, G or S
  VARIANT (55)..(55): X = Q, K, I, E, G, V, T, R, S or L
  VARIANT (56)..(56): X = S, K, or R
  VARIANT (104)..(104): X = V or I
DIQMTQSPSSLSASVGDRVTITCXASQRLRNYLAWYQQKPGKAPKLLIXAASSTXXGVPSRFSGSGSGTDFTLTISSLQPEDVATYYCQRYIQPPYTFGQGTKXEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 36 - protein, 214 aa, Artificial Sequence; identical to SEQ ID NO: 35
  modified light chain
  VARIANT (24)..(24): X = R or T
  VARIANT (49)..(49): X = R, W or G
  VARIANT (55)..(55): X = Q or I
  VARIANT (56)..(56): X = S or R
  VARIANT (104)..(104): X = V or I

SEQ ID NO: 37 - protein, 107 aa, Artificial Sequence
  modified light chain VL
  VARIANT (24)..(24): X = R, H, T, L or A
  VARIANT (49)..(49): X = Y, R, V, W, G or S
  VARIANT (55)..(55): X = Q, K, I, E, G, V, T, R, S or L
  VARIANT (56)..(56): X = S, K, or R
  VARIANT (104)..(104): X = V or I
DIQMTQSPSSLSASVGDRVTITCXASQRLRNYLAWYQQKPGKAPKLLIXAASSTXXGVPSRFSGSGSGTDFTLTISSLQPEDVATYYCQRYIQPPYTFGQGTKXEIK

SEQ ID NO: 38 - protein, 107 aa, Artificial Sequence; identical to SEQ ID NO: 37
  modified light chain VL
  VARIANT (24)..(24): X = R or T
  VARIANT (49)..(49): X = R, W or G
  VARIANT (55)..(55): X = Q or I
  VARIANT (56)..(56): X = S or R
  VARIANT (104)..(104): X = V or I

SEQ ID NO: 39 - protein, 224 aa, Artificial Sequence
  modified heavy chain
  VARIANT (31)..(31): X = D, Q or H
  VARIANT (32)..(32): X = Y or S
  VARIANT (100)..(100): X = S or K
  VARIANT (103)..(103): X = S or P
  VARIANT (107)..(107): X = S or Q
EVQLVESGGGLVQPGRSLRLSCAASGFTFDXXAMHWVRQAPGKGLEWVSAITWNSGHIDYADSVEGRFTISRDNAKNSLYLQMNSLRAEDTAVYYCAKVXYLXTASXLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 40 - protein, 120 aa, Artificial Sequence
  modified heavy chain VH
  VARIANT (31)..(31): X = D, Q or H
  VARIANT (32)..(32): X = Y or S
  VARIANT (100)..(100): X = S or K
  VARIANT (103)..(103): X = S or P
  VARIANT (107)..(107): X = S or Q
EVQLVESGGGLVQPGRSLRLSCAASGFTFDXXAMHWVRQAPGKGLEWVSAITWNSGHIDYADSVEGRFTISRDNAKNSLYLQMNSLRAEDTAVYYCAKVXYLXTASXLDYWGQGTLVTVS

SEQ ID NO: 41 - protein, 214 aa, Artificial Sequence
  modified light chain
  VARIANT (24)..(24): X = R or H
  VARIANT (27)..(27): X = Q, L, Y or K
  VARIANT (28)..(28): X = Q, R or S
  VARIANT (29)..(29): X = I or L
  VARIANT (54)..(54): X = L or F
  VARIANT (55)..(55): X = Q, K or L
  VARIANT (56)..(56): X = S, K or R
  VARIANT (92)..(92): X = N or D
  VARIANT (93)..(93): X = R, Q or K
  VARIANT (94)..(94): X = A or P
  VARIANT (95)..(95): X = P or Q
DIQMTQSPSSLSASVGDRVTITCXASXXXRNYLAWYQQKPGKAPKLLIYAASTXXXGVPSRFSGSGSGTDFTLTISSLQPEDVATYYCQRYXXXXYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 42 - protein, 107 aa, Artificial Sequence
  modified light chain VL
  VARIANT (24)..(24): X = R or H
  VARIANT (27)..(27): X = Q, L, Y or K
  VARIANT (28)..(28): X = Q, R or S
  VARIANT (29)..(29): X = I or L
  VARIANT (54)..(54): X = L or F
  VARIANT (55)..(55): X = Q, K or L
  VARIANT (56)..(56): X = S, K or R
  VARIANT (92)..(92): X = N or D
  VARIANT (93)..(93): X = R, Q or K
  VARIANT (94)..(94): X = A or P
  VARIANT (95)..(95): X = P or Q
DIQMTQSPSSLSASVGDRVTITCXASXXXRNYLAWYQQKPGKAPKLLIYAASTXXXGVPSRFSGSGSGTDFTLTISSLQPEDVATYYCQRYXXXXYTFGQGTKVEIK

SEQ ID NO: 43 - protein, 5 aa, Artificial Sequence
  modified VH CDR1 sequence
  VARIANT (1)..(1): X = D,H, Q, G, T, N or R
  VARIANT (2)..(2): X = Y, F, R, Q or S
  VARIANT (4)..(4): X = M or I
XXAXH

SEQ ID NO: 44 - protein, 17 aa, Artificial Sequence
  modified VH CDR2 sequence
  VARIANT (1)..(1): X = A or G
  VARIANT (9)..(9): X = I, V or T
  VARIANT (16)..(16): X = E or R
  VARIANT (17)..(17): X = G or N
XITWNSGHXDYADSVXX

SEQ ID NO: 45 - protein, 12 aa, Artificial Sequence
  modified VH CDR3 sequence
  VARIANT (2)..(2): X = S or K
  VARIANT (5)..(5): X = S, Q or P
  VARIANT (9)..(9): X = S or Q
VXYLXTASXLDY

SEQ ID NO: 46 - protein, 5 aa, Artificial Sequence
  modified VH CDR1 sequence
  VARIANT (1)..(1): X = D,H or Q
  VARIANT (2)..(2): X = Y or S
XXAMH

SEQ ID NO: 47 - protein, 17 aa, Artificial Sequence
  modified VH CDR2 sequence
AITWNSGHIDYADSVEG

SEQ ID NO: 48 - protein, 12 aa, Artificial Sequence
  modified VH CDR3 sequence
  VARIANT (2)..(2): X = S or K
  VARIANT (5)..(5): X = S or P
  VARIANT (9)..(9): X = S or Q
VXYLXTASXLDY

SEQ ID NO: 49 - protein, 11 aa, Artificial Sequence
  modified VL CDR1 sequence
  VARIANT (1)..(1): X = R, H, T, L or A
  VARIANT (2)..(2): X = A, T, S or G
  VARIANT (3)..(3): X = S or T
  VARIANT (4)..(4): X = Q, M, L, Y, V, W or K
  VARIANT (5)..(5): X = G, R, S, D, P or L
  VARIANT (6)..(6): X = I, V or L
XXXXXXRNYLA

SEQ ID NO: 50 - protein, 7 aa, Artificial Sequence
  modified VL CDR2 sequence
  VARIANT (3)..(3): X = S, G, N or W
  VARIANT (4)..(4): X = T, W, S, Y, G or V
  VARIANT (5)..(5): X = L, F, T or S
  VARIANT (6)..(6): X = Q, K, I, E, G, V, T, R, S or L
  VARIANT (7)..(7): X = S, K or R
AAXXXXX

SEQ ID NO: 51 - protein, 9 aa, Artificial Sequence
  modified VL CDR3 sequence
  VARIANT (4)..(4): X = N, D or I
  VARIANT (5)..(5): X = R, Q, K or M
  VARIANT (6)..(6): X = A, P or S
  VARIANT (7)..(7): X = P, F, Q, A, S, M, E or V
QRYXXXXYT

SEQ ID NO: 52 - protein, 11 aa, Artificial Sequence
  modified VL CDR1 sequence
  VARIANT (1)..(1): X = R or H
  VARIANT (4)..(4): X = Q, L, Y or K
  VARIANT (5)..(5): X = G, R or S
  VARIANT (6)..(6): X = I or L
XASXXXRNYLA

SEQ ID NO: 53 - protein, 7 aa, Artificial Sequence
  modified VL CDR2 sequence
  VARIANT (5)..(5): X = L or F
  VARIANT (6)..(6): X = Q, K or L
  VARIANT (7)..(7): X = S, K or R
AASTXXX

SEQ ID NO: 54 - protein, 9 aa, Artificial Sequence
  modified VL CDR3 sequence
  VARIANT (4)..(4): X = N or D
  VARIANT (5)..(5): X = R, Q or K
  VARIANT (6)..(6): X = A or P
  VARIANT (7)..(7): X = P or Q
QRYXXXXYT

SEQ ID NO: 55 - protein, 5 aa, Artificial Sequence
  modified VH CDR1 sequence
QFAMH

SEQ ID NO: 56 - protein, 9 aa, Artificial Sequence
  modified VL CDR3 sequence
QRYIQPPYT

SEQ ID NO: 57 - protein, 224 aa, Artificial Sequence
  recombinant TNF-alpha binder
EVQLVESGGGLVQPGRSLRLSCAASGFTFDHFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 58 - protein, 224 aa, Artificial Sequence
  recombinant TNF-alpha binder
EVQLVESGGGLVQPGRSLRLSCAASGFTFDGFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 59 - protein, 224 aa, Artificial Sequence
  recombinant TNF-alpha binder
EVQLVESGGGLVQPGRSLRLSCAASGFTFDGQAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 60 - protein, 224 aa, Artificial Sequence
  recombinant TNF-alpha binder
EVQLVESGGGLVQPGRSLRLSCAASGFTFDDSAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 61 - protein, 224 aa, Artificial Sequence
  recombinant TNF-alpha binder
EVQLVESGGGLVQPGRSLRLSCAASGFTFDTFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 62 - protein, 224 aa, Artificial Sequence
  recombinant TNF-alpha binder
EVQLVESGGGLVQPGRSLRLSCAASGFTFDQYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 63 - protein, 224 aa, Artificial Sequence
  recombinant TNF-alpha binder
EVQLVESGGGLVQPGRSLRLSCAASGFTFDNSAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 64 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTERDSKDSTYSLSSTLTLSKADYEKHKVYACEVTHQGLSSPVTKSFNRGEC

SEQ ID NO: 65 - protein, 224 aa, Artificial Sequence
  recombinant TNF-alpha binder
EVQLVESGGGLVQPGRSLRLSCAASGFTFDHYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 66 - protein, 224 aa, Artificial Sequence; identical to SEQ ID NO: 63
  recombinant TNF-alpha binder

SEQ ID NO: 67 - protein, 224 aa, Artificial Sequence
  recombinant TNF-alpha binder
EVQLVESGGGLVQPGRSLRLSCAASGFTFDNFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 68 - protein, 224 aa, Artificial Sequence; identical to SEQ ID NO: 58
  recombinant TNF-alpha binder

SEQ ID NO: 69 - protein, 224 aa, Artificial Sequence
  recombinant TNF-alpha binder
EVQLVESGGGLVQPGRSLRLSCAASGFTFDNYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 70 - protein, 224 aa, Artificial Sequence; identical to SEQ ID NO: 62
  recombinant TNF-alpha binder

SEQ ID NO: 71 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLILSKADYEKHKVYACEVTHQGLSSPVTKSFNRGEC

SEQ ID NO: 72 - protein, 224 aa, Artificial Sequence
  recombinant TNF-alpha binder
EVQLVESGGGLVQPGRSLRLSCAASGFTFDHYAMHWVRQVPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 73 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGAASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 74 - protein, 224 aa, Artificial Sequence
  recombinant TNF-alpha binder
EVQLVESGGGLVQPGRSLRLSCAASGFTFDRYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 75 - protein, 224 aa, Artificial Sequence
  recombinant TNF-alpha binder
EVQLVESGGGLVQPGRSLRLSCAASGFTFDDYAMHWVRQAPGKGLEWVSAITWNSGHTDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 76 - protein, 224 aa, Artificial Sequence
  recombinant TNF-alpha binder
EVQLVESGGGLVQPGRSLRLSCAASGFTFDDYAMHWVRQAPGKGLEWVSAITWNSGHVDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 77 - protein, 224 aa, Artificial Sequence
  recombinant TNF-alpha binder
EVQLVESGGGLVQPGRSLRLSCAASGFTFDDYAMHWVRQAPGKGLEWVSGITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 78 - protein, 224 aa, Artificial Sequence
  recombinant TNF-alpha binder
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 79 - protein, 224 aa, Artificial Sequence
  recombinant TNF-alpha binder
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLPTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 80 - protein, 214 aa, Artificial Sequence
  recombinant TNF-alpha binder
DIQMTQSPSSLSASVGDRVTITCLSSQGLRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - protein, 214 aa, Artificial Sequence
  recombinant TNF-alpha binder
DIQMTQSPSSLSASVGDRVTITCAASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 82 - protein, 214 aa, Artificial Sequence
  recombinant TNF-alpha binder
DIQMTQSPSSLSASVGDRVTITCLSSQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 83 - protein, 214 aa, Artificial Sequence
  recombinant TNF-alpha binder
DIQMTQSPSSLSASVGDRVTITCTASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 84 - protein, 214 aa, Artificial Sequence
  recombinant TNF-alpha binder
DIQMTQSPSSLSASVGDRVTITCRSSQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 214 aa, Artificial Sequence
  recombinant TNF-alpha binder
DIQMTQSPSSLSASVGDRVTITCLGSQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 214 aa, Artificial Sequence
  recombinant TNF-alpha binder
DIQMTQSPSSLSASVGDRVTITCRASQSLRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 87 - protein, 214 aa, Artificial Sequence
  recombinant TNF-alpha binder
DIQMTQSPSSLSASVGDRVTITCRASQPVRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 88 - protein, 214 aa, Artificial Sequence
  recombinant TNF-alpha binder
DIQMTQSPSSLSASVGDRVTITCRASQPLRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 214 aa, Artificial Sequence
  recombinant TNF-alpha binder
DIQMTQSPSSLSASVGDRVTITCRASQRVRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 214 aa, Artificial Sequence
  recombinant TNF-alpha binder
DIQMTQSPSSLSASVGDRVTITCRASQRLRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - protein, 214 aa, Artificial Sequence
  recombinant TNF-alpha binder
DIQMTQSPSSLSASVGDRVTITCRASLGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 214 aa, Artificial Sequence
  recombinant TNF-alpha binder
DIQMTQSPSSLSASVGDRVTITCRTSMGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 214 aa, Artificial Sequence
  recombinant TNF-alpha binder
DIQMTQSPSSLSASVGDRVTITCRATYGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 214 aa, Artificial Sequence
  recombinant TNF-alpha binder
DIQMTQSPSSLSASVGDRVTITCRASYGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 214 aa, Artificial Sequence
  recombinant TNF-alpha binder
DIQMTQSPSSLSASVGDRVTITCRASQLIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 214 aa, Artificial Sequence
  recombinant TNF-alpha binder
DIQMTQSPSSLSASVGDRVTITCRASVGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 97 - protein, 214 aa, Artificial Sequence
  recombinant TNF-alpha binder
DIQMTQSPSSLSASVGDRVTITCRASWGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 214 aa, Artificial Sequence
  recombinant TNF-alpha binder
DIQMTQSPSSLSASVGDRVTITCRASKGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 214 aa, Artificial Sequence
  recombinant TNF-alpha binder
DIQMTQSPSSLSASVGDRVTITCRASQGIRNYLAWYQQKPGKAPKLLIYAAWWLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 100 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 214 aa, Artificial Sequence
  recombinant TNF-alpha binder
DIQMTQSPSSLSASVGDRVTITCRASQGIRNYLAWYQQKPGKAPKLLIYAANWLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 214 aa, Artificial Sequence
  recombinant TNF-alpha binder
DIQMTQSPSSLSASVGDRVTITCRASQGIRNYLAWYQQKPGKAPKLLIYAASYLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 224 aa, Artificial Sequence; identical to SEQ ID NO: 1
  recombinant TNF-alpha binder

SEQ ID NO: 104 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 214 aa, Artificial Sequence
  recombinant TNF-alpha binder
DIQMTQSPSSLSASVGDRVTITCRASQGIRNYLAWYQQKPGKAPKLLIYAASGLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 224 aa, Artificial Sequence; identical to SEQ ID NO: 1
  recombinant TNF-alpha binder

SEQ ID NO: 107 - protein, 214 aa, Artificial Sequence; identical to SEQ ID NO: 102
  recombinant TNF-alpha binder

SEQ ID NO: 108 - protein, 214 aa, Artificial Sequence
  recombinant TNF-alpha binder
DIQMTQSPSSLSASVGDRVTITCRASQGIRNYLAWYQQKPGKAPKLLIYAASFLQSSVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 214 aa, Artificial Sequence
  recombinant TNF-alpha binder
DIQMTQSPSSLSASVGDRVTITCRASQGIRNYLAWYQQKPGKAPKLLIYAASFLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 214 aa, Artificial Sequence
  recombinant TNF-alpha binder
DIQMTQSPSSLSASVGDRVTITCRASQGIRNYLAWYQQKPGKAPKLLIYAASSLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 214 aa, Artificial Sequence
  recombinant TNF-alpha binder
DIQMTQSPSSLSASVGDRVTITCRASQGIRNYLAWYQQKPGKAPKLLIYAASVLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 224 aa, Artificial Sequence
  recombinant TNF-alpha binder
EVQLVESGGGLVQPGRSLRLSCAASGFTFDDYAMHWVRQAPGKGLEWVSAITWNSGHIDYADSVRNRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 113 - protein, 213 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 114 - protein, 214 aa, Artificial Sequence
  recombinant TNF-alpha binder
DIQMTQSPSSLSASVGDRVTITCRASQGIRNYLAWYQQKPGKAPKLLIYAASTLQRGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 115 - protein, 214 aa, Artificial Sequence
  recombinant TNF-alpha binder
DIQMTQSPSSLSASVGDRVTITCRASQGIRNYLAWYQQKPGKAPKLLIYAASTSQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 116 - protein, 214 aa, Artificial Sequence; identical to SEQ ID NO: 101
  recombinant TNF-alpha binder

SEQ ID NO: 117 - protein, 214 aa, Artificial Sequence
  recombinant TNF-alpha binder
DIQMTQSPSSLSASVGDRVTITCRASQGIRNYLAWYQQKPGKAPKLLIYAASTTISGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - protein, 214 aa, Artificial Sequence
  recombinant TNF-alpha binder
DIQMTQSPSSLSASVGDRVTITCRASQGIRNYLAWYQQKPGKAPKLLIYAASTTKSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - protein, 214 aa, Artificial Sequence
  recombinant TNF-alpha binder
DIQMTQSPSSLSASVGDRVTITCRASQGIRNYLAWYQQKPGKAPKLLIYAASTTLSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 120 - protein, 214 aa, Artificial Sequence
  recombinant TNF-alpha binder
DIQMTQSPSSLSASVGDRVTITCRASQGIRNYLAWYQQKPGKAPKLLIYAANYLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 121 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 123 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 124 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNMPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 125 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNKSPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYDMAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 129 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRPQYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRPAYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 131 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRPSYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 132 - protein, 214 aa, Artificial Sequence
  recombinant TNF-alpha binder
DIQMTQSPSSLSASMGDRVTITCRASQGIRNYLAWYQQKPGKAPKLLIYAASTLQSGVPSRFSGSGSGTDFTLTISSLQPEDVATYYCQRYNRPMYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRPEYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 134 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNRPVYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 135 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYIRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 136 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNKAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYNMAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - protein, 224 aa, Artificial Sequence; identical to SEQ ID NO: 65
  recombinant TNF-alpha binder

SEQ ID NO: 140 - protein, 214 aa, Artificial Sequence
  recombinant TNF-alpha binder
DIQMTQSPSSLSASVGDRVTITCRASQGIRNYLAWYQQKPGKAPKLLIYAANTLQSGVPSRFSGSGSGTDFTLTISSLQPEDVATYYCQRYIKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 141 - protein, 224 aa, Artificial Sequence; identical to SEQ ID NO: 65
  recombinant TNF-alpha binder

SEQ ID NO: 142 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 143 - protein, 224 aa, Artificial Sequence
  recombinant TNF-alpha binder
EVRLVESGGGLVQPGRSLRLSCAASGFTFDGSAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 144 - protein, 214 aa, Artificial Sequence
  recombinant TNF-alpha binder
DIQMTQSPSSLSASVGDRVTITCRASQGIRNYLAWYQQKPGKAPKLLIYAANWLQSGVPSRFSGSGSGTDFTLTISSLQPEDVATYYCQRYNKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 145 - protein, 224 aa, Artificial Sequence
  recombinant TNF-alpha binder
EVQLVESGGGLVQPGRSLRLSCAASGFTFDDFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 146 - protein, 214 aa, Artificial Sequence
  recombinant TNF-alpha binder
DIQMTQSPSSLSASVGDRVTITCRASQGIRNYLAWYQQKPGKAPKLLIYAANWLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEATHQGLSSPVTKSFNRGEC

SEQ ID NO: 147 - protein, 224 aa, Artificial Sequence
  recombinant TNF-alpha binder
EVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 148 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 149 - protein, 120 aa, Artificial Sequence
  recombinant TNF-alpha binder
EVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVSYLSTASSLDYWGQGTLVTVS

SEQ ID NO: 150 - protein, 107 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYIQPPYTFGQGTKVEIK

SEQ ID NO: 151 - protein, 224 aa, Artificial Sequence; identical to SEQ ID NO: 147
  recombinant TNF-alpha binder

SEQ ID NO: 152 - protein, 214 aa, Artificial Sequence
  recombinant TNF-alpha binder
DIQMTQSPSSLSASVGDRVTITCRASQGIRNYLAWYQQKPGKAPKLLIYAAGWLQSGMPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 224 aa, Artificial Sequence; identical to SEQ ID NO: 147
  recombinant TNF-alpha binder

SEQ ID NO: 154 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYIQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 155 - protein, 224 aa, Artificial Sequence; identical to SEQ ID NO: 60
  recombinant TNF-alpha binder

SEQ ID NO: 156 - protein, 214 aa, Artificial Sequence
  recombinant TNF-alpha binder
DIQMTQSPSSLSASVGDRVTITCRASQGIRNYLAWYQQKPGKAPKLLIYAAWWLQSGMPSRFSGSGSGTDFTLTISSLQPEDVATYYCQRYNKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 157 - protein, 224 aa, Artificial Sequence; identical to SEQ ID NO: 62
  recombinant TNF-alpha binder

SEQ ID NO: 158 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYIRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 159 - protein, 224 aa, Artificial Sequence; identical to SEQ ID NO: 62
  recombinant TNF-alpha binder

SEQ ID NO: 160 - protein, 214 aa, Artificial Sequence
  recombinant TNF-alpha binder
DIQMTQSPSSLSASVGDRVTITCRASQGIRNYLAWYQQKPGKAPKLLIYAAGTLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 161 - protein, 224 aa, Artificial Sequence; identical to SEQ ID NO: 147
  recombinant TNF-alpha binder

SEQ ID NO: 162 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 163 - protein, 224 aa, Artificial Sequence; identical to SEQ ID NO: 57
  recombinant TNF-alpha binder

SEQ ID NO: 164 - protein, 214 aa, Artificial Sequence; identical to SEQ ID NO: 142
  recombinant TNF-alpha binder

SEQ ID NO: 165 - protein, 224 aa, Artificial Sequence; identical to SEQ ID NO: 69
  recombinant TNF-alpha binder

SEQ ID NO: 166 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYIKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 167 - protein, 224 aa, Artificial Sequence; identical to SEQ ID NO: 147
  recombinant TNF-alpha binder

SEQ ID NO: 168 - protein, 214 aa, Artificial Sequence; identical to SEQ ID NO: 160
  recombinant TNF-alpha binder

SEQ ID NO: 169 - protein, 224 aa, Artificial Sequence; identical to SEQ ID NO: 60
  recombinant TNF-alpha binder

SEQ ID NO: 170 - protein, 214 aa, Artificial Sequence
  recombinant TNF-alpha binder
DIQMTQSPSSLSASVGDRVTITCRASQGIRNYLAWYQQKPGKAPKLLIYAAGWLQSGMPSRFSGSGSGTDFTLTISSLQPEDVATYYCQRYNQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 171 - protein, 224 aa, Artificial Sequence; identical to SEQ ID NO: 62
  recombinant TNF-alpha binder

SEQ ID NO: 172 - protein, 214 aa, Artificial Sequence; identical to SEQ ID NO: 100
  recombinant TNF-alpha binder

SEQ ID NO: 173 - protein, 224 aa, Artificial Sequence; identical to SEQ ID NO: 57
  recombinant TNF-alpha binder

SEQ ID NO: 174 - protein, 214 aa, Artificial Sequence
  recombinant TNF-alpha binder
DIQMTQSPSSLSASVGDRVTITCRASQGIRNYLAWYQQKPGKAPKLLIYAAGTLQSGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 175 - protein, 224 aa, Artificial Sequence; identical to SEQ ID NO: 147
  recombinant TNF-alpha binder

SEQ ID NO: 176 - protein, 214 aa, Artificial Sequence; identical to SEQ ID NO: 104
  recombinant TNF-alpha binder

SEQ ID NO: 177 - protein, 224 aa, Artificial Sequence; identical to SEQ ID NO: 147
  recombinant TNF-alpha binder

SEQ ID NO: 178 - protein, 214 aa, Artificial Sequence; identical to SEQ ID NO: 154
  recombinant TNF-alpha binder

SEQ ID NO: 179 - protein, 224 aa, Artificial Sequence; identical to SEQ ID NO: 62
  recombinant TNF-alpha binder

SEQ ID NO: 180 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYIQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - protein, 224 aa, Artificial Sequence; identical to SEQ ID NO: 62
  recombinant TNF-alpha binder

SEQ ID NO: 182 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYNQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 183 - protein, 224 aa, Artificial Sequence; identical to SEQ ID NO: 62
  recombinant TNF-alpha binder

SEQ ID NO: 184 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYNKAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 185 - protein, 224 aa, Artificial Sequence; identical to SEQ ID NO: 60
  recombinant TNF-alpha binder

SEQ ID NO: 186 - protein, 214 aa, Artificial Sequence; identical to SEQ ID NO: 142
  recombinant TNF-alpha binder

SEQ ID NO: 187 - protein, 224 aa, Artificial Sequence; identical to SEQ ID NO: 58
  recombinant TNF-alpha binder

SEQ ID NO: 188 - protein, 214 aa, Artificial Sequence
  recombinant TNF-alpha binder
DIQMTQSPSSLSASVGDRVTITCRASQGIRNYLAWYQQKPGKAPKLLISAAGWLQSGVPSRFSGSGSGTDFTLTISSLQPEDVATYYCQRYNQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 189 - protein, 224 aa, Artificial Sequence; identical to SEQ ID NO: 62
  recombinant TNF-alpha binder

SEQ ID NO: 190 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYNQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 191 - protein, 224 aa, Artificial Sequence; identical to SEQ ID NO: 62
  recombinant TNF-alpha binder

SEQ ID NO: 192 - protein, 214 aa, Artificial Sequence; identical to SEQ ID NO: 142
  recombinant TNF-alpha binder

SEQ ID NO: 193 - protein, 224 aa, Artificial Sequence; identical to SEQ ID NO: 62
  recombinant TNF-alpha binder

SEQ ID NO: 194 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYNMPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 195 - protein, 224 aa, Artificial Sequence; identical to SEQ ID NO: 62
  recombinant TNF-alpha binder

SEQ ID NO: 196 - protein, 214 aa, Artificial Sequence; identical to SEQ ID NO: 166
  recombinant TNF-alpha binder

SEQ ID NO: 197 - protein, 224 aa, Artificial Sequence; identical to SEQ ID NO: 60
  recombinant TNF-alpha binder

SEQ ID NO: 198 - protein, 214 aa, Artificial Sequence; identical to SEQ ID NO: 160
  recombinant TNF-alpha binder

SEQ ID NO: 199 - protein, 224 aa, Artificial Sequence
  recombinant TNF-alpha binder
EVQLVESGGGLVQPGRSLRLSCAASGFTFDGFAIHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 200 - protein, 214 aa, Artificial Sequence; identical to SEQ ID NO: 154
  recombinant TNF-alpha binder

SEQ ID NO: 201 - protein, 224 aa, Artificial Sequence; identical to SEQ ID NO: 62
  recombinant TNF-alpha binder

SEQ ID NO: 202 - protein, 214 aa, Artificial Sequence; identical to SEQ ID NO: 123
  recombinant TNF-alpha binder

SEQ ID NO: 203 - protein, 214 aa, Artificial Sequence
  recombinant TNF-alpha binder
DIQMTQSPSSLSASVGDRVTITCRASQGIRNYLAWYQQKPGKAPKLLIYAASTLERGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - protein, 214 aa, Artificial Sequence
  recombinant TNF-alpha binder
DIQMTQSPSSLSASVGDRVTITCRASQGIRNYLAWYQQKPGKAPKLLIYAASTLGRGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 205 - protein, 214 aa, Artificial Sequence
  recombinant TNF-alpha binder
DIQMTQSPSSLSASVGDRVTITCRASQGIRNYLAWYQQKPGKAPKLLIYAASTLVRGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 206 - protein, 214 aa, Artificial Sequence
  recombinant TNF-alpha binder
DIQMTQSPSSLSASVGDRVTITCRASQGIRNYLAWYQQKPGKAPKLLIYAASTLTRGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 207 - protein, 214 aa, Artificial Sequence
  recombinant TNF-alpha binder
DIQMTQSPSSLSASVGDRVTITCRASQGIRNYLAWYQQKPGKAPKLLIYAASTLRRGMPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 208 - protein, 214 aa, Artificial Sequence
  recombinant TNF-alpha binder
DIQMTQSPSSLSASVGDRVTITCRASQGIRNYLAWYQQKPGKAPKLLIYAASTLSRGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 209 - protein, 214 aa, Artificial Sequence
  recombinant TNF-alpha binder
DIQMTQSPSSLSASVGDRVTITCRASQGIRNYLAWYQQKPGKAPKLLIRAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 210 - protein, 224 aa, Artificial Sequence
  recombinant TNF-alpha binder
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKMEPKSC

SEQ ID NO: 211 - protein, 214 aa, Artificial Sequence; identical to SEQ ID NO: 209
  recombinant TNF-alpha binder

SEQ ID NO: 212 - protein, 214 aa, Artificial Sequence
  recombinant TNF-alpha binder
DIQMTQSPSSLSASVGDRVTITCRASQGIRNYLAWYQQKPGKAPKLLIVAASTLQSGMPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 213 - protein, 214 aa, Artificial Sequence
  recombinant TNF-alpha binder
DIQMTQSPSSLSASVGDRVTITCRASQGIRNYLAWYQQKPGKAPKLLIWAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 214 - protein, 224 aa, Artificial Sequence
  recombinant TNF-alpha binder
EVQLVESGGGLVQPGRSLRLSCAASGFTFGDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 215 - protein, 224 aa, Artificial Sequence; identical to SEQ ID NO: 214
  recombinant TNF-alpha binder

SEQ ID NO: 216 - protein, 224 aa, Artificial Sequence
  recombinant TNF-alpha binder
EVQLVESGGGLVQPGRSLRLSCAASGFTFRDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 217 - protein, 224 aa, Artificial Sequence; identical to SEQ ID NO: 147
  recombinant TNF-alpha binder

SEQ ID NO: 218 - protein, 214 aa, Artificial Sequence
  recombinant TNF-alpha binder
DIQMTQSPSSLSASVGDRVTITCRASQGIRNYLAWYQQKPGKAPKLLIYAAGWLQSGVPSRFSGSGSGTDFTLTISSLQPEDVATYYCQRYNKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 219 - protein, 224 aa, Artificial Sequence; identical to SEQ ID NO: 62
  recombinant TNF-alpha binder

SEQ ID NO: 220 - protein, 214 aa, Artificial Sequence
  recombinant TNF-alpha binder
DIQMTQSPSSLSASVGDRVTITCRASQGIRNYLAWYQQKPGKAPKLLIYAANWLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 221 - protein, 224 aa, Artificial Sequence; identical to SEQ ID NO: 62
  recombinant TNF-alpha binder

SEQ ID NO: 222 - protein, 214 aa, Artificial Sequence; identical to SEQ ID NO: 220
  recombinant TNF-alpha binder

SEQ ID NO: 223 - protein, 224 aa, Artificial Sequence; identical to SEQ ID NO: 147
  recombinant TNF-alpha binder

SEQ ID NO: 224 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYNKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - protein, 224 aa, Artificial Sequence; identical to SEQ ID NO: 147
  recombinant TNF-alpha binder

SEQ ID NO: 226 - protein, 214 aa, Artificial Sequence
  recombinant TNF-alpha binder
DIQMTQSPSSLSASVGDRVTITCRASQGIRNYLAWYQQKPGKAPKLLIYAANTLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 227 - protein, 224 aa, Artificial Sequence; identical to SEQ ID NO: 147
  recombinant TNF-alpha binder

SEQ ID NO: 228 - protein, 214 aa, Artificial Sequence; identical to SEQ ID NO: 121
  recombinant TNF-alpha binder

SEQ ID NO: 229 - protein, 224 aa, Artificial Sequence; identical to SEQ ID NO: 57
  recombinant TNF-alpha binder

SEQ ID NO: 230 - protein, 214 aa, Artificial Sequence; identical to SEQ ID NO: 121
  recombinant TNF-alpha binder

SEQ ID NO: 231 - protein, 224 aa, Artificial Sequence
  recombinant TNF-alpha binder
EVQLIESGGGLVQPGRSLRLSCAASGFTFDQYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 232 - protein, 214 aa, Artificial Sequence
  recombinant TNF-alpha binder
DIQMTQSPSSLSASVGDRVTITCRASQGIRNYLAWYQQKPGKAPKLLIYAAWWLQSGVPSRFSGSGSGTDFTLTISSLQPEDVATYYCQRYNMPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 233 - protein, 224 aa, Artificial Sequence; identical to SEQ ID NO: 147
  recombinant TNF-alpha binder

SEQ ID NO: 234 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYIKAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 235 - protein, 224 aa, Artificial Sequence
  recombinant TNF-alpha binder
EVQLVESGGGLVQPGRSLRLSCAASGFTFDGYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 236 - protein, 214 aa, Artificial Sequence; identical to SEQ ID NO: 160
  recombinant TNF-alpha binder

SEQ ID NO: 237 - protein, 224 aa, Artificial Sequence; identical to SEQ ID NO: 147
  recombinant TNF-alpha binder

SEQ ID NO: 238 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQPEDVATYYCQRYIMPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 239 - protein, 224 aa, Artificial Sequence; identical to SEQ ID NO: 147
  recombinant TNF-alpha binder

SEQ ID NO: 240 - protein, 214 aa, Artificial Sequence; identical to SEQ ID NO: 160
  recombinant TNF-alpha binder

SEQ ID NO: 241 - protein, 224 aa, Artificial Sequence
  recombinant TNF-alpha binder
EVQLVESGGGLVQPGRSLRLSCAASGFSFDQYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 242 - protein, 214 aa, Artificial Sequence
  recombinant TNF-alpha binder
DIQMTQSPSSLSASVGDRVTITCRASQGIRNYLAWYQQKPGKAPKLLIYAAWWLQSGVPSRFSGSGSGTDFTLTISSLQPEDVATYYCQRYIQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 224 aa, Artificial Sequence; identical to SEQ ID NO: 147
  recombinant TNF-alpha binder

SEQ ID NO: 244 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYNQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVAHQGLSSPVTKSFNRGEC

SEQ ID NO: 245 - protein, 224 aa, Artificial Sequence; identical to SEQ ID NO: 147
  recombinant TNF-alpha binder

SEQ ID NO: 246 - protein, 214 aa, Artificial Sequence; identical to SEQ ID NO: 101
  recombinant TNF-alpha binder

SEQ ID NO: 247 - protein, 224 aa, Artificial Sequence
  recombinant TNF-alpha binder
EVQLVESGGGLVQPGRSLRLSCAASGFTFDQFAMHWVRRAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 248 - protein, 214 aa, Artificial Sequence
  recombinant TNF-alpha binder
DIQMTQSPSSLSASVGDRVTITCRASQGIRNYLAWYQQKPGKAPKLLIYAANTLQSGVPSRFSGSGSGTDFTLTISSLQPEDVATYYCQRYIQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 224 aa, Artificial Sequence; identical to SEQ ID NO: 147
  recombinant TNF-alpha binder

SEQ ID NO: 250 - protein, 214 aa, Artificial Sequence
  recombinant TNF-alpha binder
DIQMSQSPSSLSASVGDRVTITCRASQGIRNYLAWYQQKPGKAPKLLIYAANTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 251 - protein, 224 aa, Artificial Sequence; identical to SEQ ID NO: 57
  recombinant TNF-alpha binder

SEQ ID NO: 252 - protein, 214 aa, Artificial Sequence; identical to SEQ ID NO: 121
  recombinant TNF-alpha binder

SEQ ID NO: 253 - protein, 224 aa, Artificial Sequence
  recombinant TNF-alpha binder
EVQLVESGGGLVQPGRSLRLSCAASGFTFDHRAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 254 - protein, 214 aa, Artificial Sequence
  recombinant TNF-alpha binder
DIQMTQSPSSLSASVGDRVTITCRASQGIRNYLAWYQQKPGKAPKLLIYAANWLQSGVPSRFSGSGSGTDFTLTISSLQPEDVATYYCQRYIRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 255 - protein, 224 aa, Artificial Sequence
  recombinant TNF-alpha binder
KVQLVESGGGLVQPGRSLRLSCAASGFTFDHFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 256 - protein, 214 aa, Artificial Sequence
  recombinant TNF-alpha binder
DIQMTQSPSSLSASVGDRVTITCRASQGIRNYLAWYQQKPGKAPKLLIYAASTLQSGVPSRFSGSGSGTDFTLTISSLQQEDVATYYCQRYIKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 257 - protein, 224 aa, Artificial Sequence
  recombinant TNF-alpha binder
EVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVSYLPTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 258 - protein, 214 aa, Artificial Sequence; identical to SEQ ID NO: 148
  recombinant TNF-alpha binder

SEQ ID NO: 259 - protein, 224 aa, Artificial Sequence
  recombinant TNF-alpha binder
EVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVKYLPTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 260 - protein, 214 aa, Artificial Sequence
  recombinant TNF-alpha binder
DIQMTQSPSSLSASVGDRVTITCRASQGIRNYLAWYQQKPGKAPKLLIYAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 261 - protein, 224 aa, Artificial Sequence; identical to SEQ ID NO: 257
  recombinant TNF-alpha binder

SEQ ID NO: 262 - protein, 214 aa, Artificial Sequence
  recombinant TNF-alpha binder
DIQMTQSPSSLSASVGDRVTITCRASQRIRNYLAWYQQKPGKAPKLLIYAASWTQSGVPSRFSGSGSGTDFTLTISSLQPEDVATYYCQRYNQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 263 - protein, 224 aa, Artificial Sequence
  recombinant TNF-alpha binder
EVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 264 - protein, 214 aa, Artificial Sequence
  recombinant TNF-alpha binder
DIQMTQSPSSLSASVGDRVTITCRASQGLRNYLAWYQQKPGKAPKLLIYAASSTIRGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 120 aa, Artificial Sequence
  recombinant TNF-alpha binder
EVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVKYLSTASSLDYWGQGTLVTVS

SEQ ID NO: 266 - protein, 107 aa, Artificial Sequence
  recombinant TNF-alpha binder
DIQMTQSPSSLSASVGDRVTITCRASQGLRNYLAWYQQKPGKAPKLLIYAASSTIRGVPSRFSGSGSGTDFTLTISSLQPEDVATYYCQRYIQPPYTFGQGTKVEIK

SEQ ID NO: 267 - protein, 224 aa, Artificial Sequence; identical to SEQ ID NO: 259
  recombinant TNF-alpha binder

SEQ ID NO: 268 - protein, 214 aa, Artificial Sequence
  recombinant TNF-alpha binder
DIQMTQSPSSLSASVGDRVTITCRASQGLRNYLAWYQQKPGKAPKLLIYAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 269 - protein, 224 aa, Artificial Sequence; identical to SEQ ID NO: 147
  recombinant TNF-alpha binder

SEQ ID NO: 270 - protein, 214 aa, Artificial Sequence
  recombinant TNF-alpha binder
DIQMTQSPSSLSASVGDRVTITCRASQRLRNYLAWYQQKPGKAPKLLIYAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - protein, 120 aa, Artificial Sequence; identical to SEQ ID NO: 149
  recombinant TNF-alpha binder

SEQ ID NO: 272 - protein, 107 aa, Artificial Sequence
  recombinant TNF-alpha binder
DIQMTQSPSSLSASVGDRVTITCRASQRLRNYLAWYQQKPGKAPKLLIYAASSTISGVPSRFSGSGSGTDFTLTISSLQPEDVATYYCQRYIQPPYTFGQGTKVEIK

SEQ ID NO: 273 - protein, 224 aa, Artificial Sequence; identical to SEQ ID NO: 147
  recombinant TNF-alpha binder

SEQ ID NO: 274 - protein, 214 aa, Artificial Sequence; identical to SEQ ID NO: 148
  recombinant TNF-alpha binder

SEQ ID NO: 275 - protein, 224 aa, Artificial Sequence; identical to SEQ ID NO: 257
  recombinant TNF-alpha binder

SEQ ID NO: 276 - protein, 214 aa, Artificial Sequence
  recombinant TNF-alpha binder
DIQMTQSPSSLSASVGDRVTITCRASQRIRNYLAWYQQKPGKAPKLLIYAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 224 aa, Artificial Sequence; identical to SEQ ID NO: 147
  recombinant TNF-alpha binder

SEQ ID NO: 278 - protein, 214 aa, Artificial Sequence; identical to SEQ ID NO: 148
  recombinant TNF-alpha binder

SEQ ID NO: 279 - protein, 224 aa, Artificial Sequence; identical to SEQ ID NO: 147
  recombinant TNF-alpha binder

SEQ ID NO: 280 - protein, 214 aa, Artificial Sequence; identical to SEQ ID NO: 148
  recombinant TNF-alpha binder

SEQ ID NO: 281 - protein, 224 aa, Artificial Sequence; identical to SEQ ID NO: 257
  recombinant TNF-alpha binder

SEQ ID NO: 282 - protein, 214 aa, Artificial Sequence; identical to SEQ ID NO: 276
  recombinant TNF-alpha binder

SEQ ID NO: 283 - protein, 224 aa, Artificial Sequence; identical to SEQ ID NO: 259
  recombinant TNF-alpha binder

SEQ ID NO: 284 - protein, 214 aa, Artificial Sequence
  recombinant TNF-alpha binder
DIQMTQSPSSLSASVGDRVTITCRASMGLRNYLAWYQQKPGKAPKLLIYAASSTISGVPSRFSGSGSGTDFTLTISSLQPEDVATYYCQRYDQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 285 - protein, 224 aa, Artificial Sequence; identical to SEQ ID NO: 259
  recombinant TNF-alpha binder

SEQ ID NO: 286 - protein, 214 aa, Artificial Sequence
  recombinant TNF-alpha binder
DIQMTQSPSSLSASVGDRVTITCRASQGLRNYLAWYQQKPGKAPKLLIYAASSLIRGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 287 - protein, 224 aa, Artificial Sequence; identical to SEQ ID NO: 259
  recombinant TNF-alpha binder

SEQ ID NO: 288 - protein, 214 aa, Artificial Sequence
  recombinant TNF-alpha binder
DIQMTQSPSSLSASVGDRVTITCTTSQGIRNYLAWYQQKPGKAPKLLIYAASWLQSGVPSRFSGSGSGTDFTLTISSLQPEDVATYYCQRYDQPFYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 289 - protein, 224 aa, Artificial Sequence; identical to SEQ ID NO: 263
  recombinant TNF-alpha binder

SEQ ID NO: 290 - protein, 214 aa, Artificial Sequence
  recombinant TNF-alpha binder
DIQMTQSPSSLSASVGDRVTITCTASQRLRNYLAWYQQKPGKAPKLLIYAASSTQRGVPSRFSGSGSGTDFTLTISSLQPEDVATYYCQRYIQPPYTFGQGTKIEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 291 - protein, 120 aa, Artificial Sequence; identical to SEQ ID NO: 265
  recombinant TNF-alpha binder

SEQ ID NO: 292 - protein, 107 aa, Artificial Sequence
  recombinant TNF-alpha binder
DIQMTQSPSSLSASVGDRVTITCTASQRLRNYLAWYQQKPGKAPKLLIYAASSTQRGVPSRFSGSGSGTDFTLTISSLQPEDVATYYCQRYIQPPYTFGQGTKIEIK

SEQ ID NO: 293 - protein, 224 aa, Artificial Sequence; identical to SEQ ID NO: 147
  recombinant TNF-alpha binder

SEQ ID NO: 294 - protein, 214 aa, Artificial Sequence; identical to SEQ ID NO: 270
  recombinant TNF-alpha binder

SEQ ID NO: 295 - protein, 120 aa, Artificial Sequence; identical to SEQ ID NO: 149
  recombinant TNF-alpha binder

SEQ ID NO: 296 - protein, 107 aa, Artificial Sequence; identical to SEQ ID NO: 272
  recombinant TNF-alpha binder

SEQ ID NO: 297 - protein, 224 aa, Artificial Sequence; identical to SEQ ID NO: 257
  recombinant TNF-alpha binder

SEQ ID NO: 298 - protein, 214 aa, Artificial Sequence
  recombinant TNF-alpha binder
DIQMTQSPSSLSASVGDRVTITCRASQGIRNYLAWYQQKPGKAPKLLIYAASSTQRGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 224 aa, Artificial Sequence; identical to SEQ ID NO: 257
  recombinant TNF-alpha binder

SEQ ID NO: 300 - protein, 214 aa, Artificial Sequence
  recombinant TNF-alpha binder
DIQMTQSPSSLSASVGDRVTITCRASQRIRNYLAWYQQKPGKAPKLLIYAASWLQRGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 224 aa, Artificial Sequence
  recombinant TNF-alpha binder
EVQLVESGGGLVQPGRSLRLSCAASGFTFGQFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 302 - protein, 214 aa, Artificial Sequence
  recombinant TNF-alpha binder
DIQMTQSPSSLSASVGDRVTITCRASQRLRNYLAWYQQKPGKAPKLLIGAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 303 - protein, 120 aa, Artificial Sequence
  recombinant TNF-alpha binder
EVQLVESGGGLVQPGRSLRLSCAASGFTFGQFAMHWVRQAPGKGLEWVSAITWNSGHIDYADSVEGRFTISRDNAKNSLYLQMNSLRAEDTAVYYCAKVSYLSTASSLDYWGQGTLVTVS

SEQ ID NO: 304 - protein, 107 aa, Artificial Sequence
  recombinant TNF-alpha binder
DIQMTQSPSSLSASVGDRVTITCRASQRLRNYLAWYQQKPGKAPKLLIGAASSTISGVPSRFSGSGSGTDFTLTISSLQPEDVATYYCQRYIQPPYTFGQGTKVEIK

SEQ ID NO: 305 - protein, 224 aa, Artificial Sequence
  recombinant TNF-alpha binder
EVQLVESGGGLVHPGRSLRLSCAASGFTFGQFAMHWVRQAPGKGLEWVSAITWNSGHIDYADSVEGRFTISRDNAKNSLYLQMNSLRAEDTAVYYCAKVSYLPTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 306 - protein, 214 aa, Artificial Sequence
  recombinant TNF-alpha binder
DIQMTQSPSSLSASVGDRVTITCRASQRLRNYLAWYQQKPGKAPKLLIRAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 224 aa, Artificial Sequence
  recombinant TNF-alpha binder
EVQLVESGGGLVQPGRSLRLSCAASGFTFGQFAMHWVRQAPGKGLEWVSAITWNSGHIDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 308 - protein, 214 aa, Artificial Sequence
  recombinant TNF-alpha binder
DIQMTQSPSSLSASVGDRVTITCTASQRLRNYLAWYQQKPGKAPKLLIGAASSTQRGVPSRFSGSGSGTDFTLTISSLQPEDVATYYCQRYIQPPYTFGQGTKIEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 120 aa, Artificial Sequence
  recombinant TNF-alpha binder
EVQLVESGGGLVQPGRSLRLSCAASGFTFGQFAMHWVRQAPGKGLEWVSAITWNSGHIDYADSVEGRFTISRDNAKNSLYLQMNSLRAEDTAVYYCAKVKYLSTASSLDYWGQGTLVTVS

SEQ ID NO: 310 - protein, 107 aa, Artificial Sequence
  recombinant TNF-alpha binder
DIQMTQSPSSLSASVGDRVTITCTASQRLRNYLAWYQQKPGKAPKLLIGAASSTQRGVPSRFSGSGSGTDFTLTISSLQPEDVATYYCQRYIQPPYTFGQGTKIEIK

SEQ ID NO: 311 - protein, 224 aa, Artificial Sequence; identical to SEQ ID NO: 307
  recombinant TNF-alpha binder

SEQ ID NO: 312 - protein, 214 aa, Artificial Sequence
  recombinant TNF-alpha binder
DIQMTQSPSSLSASVGDRVTITCTASQRLRNYLAWYQQKPGKAPKLLIWAASSTQRGVPSRFSGSGSGTDFTLTISSLQPEDVATYYCQRYIQPPYTFGQGTKIEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 120 aa, Artificial Sequence; identical to SEQ ID NO: 309
  recombinant TNF-alpha binder

SEQ ID NO: 314 - protein, 107 aa, Artificial Sequence
  recombinant TNF-alpha binder
DIQMTQSPSSLSASVGDRVTITCTASQRLRNYLAWYQQKPGKAPKLLIWAASSTQRGVPSRFSGSGSGTDFTLTISSLQPEDVATYYCQRYIQPPYTFGQGTKIEIK

SEQ ID NO: 315 - protein, 224 aa, Artificial Sequence; identical to SEQ ID NO: 147
  recombinant TNF-alpha binder

SEQ ID NO: 316 - protein, 214 aa, Artificial Sequence
  recombinant TNF-alpha binder
DIQMTQSPSSLSASVGDRVTITCRASQRLRNYLAWYQQKPGKAPKLLIWAASSTISGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 224 aa, Artificial Sequence; identical to SEQ ID NO: 263
  recombinant TNF-alpha binder

SEQ ID NO: 318 - protein, 214 aa, Artificial Sequence; identical to SEQ ID NO: 308
  recombinant TNF-alpha binder

SEQ ID NO: 319 - protein, 224 aa, Artificial Sequence
  recombinant TNF-alpha binder
EVQLVESGGGLVQPGRSLRLSCAASGFTFDHFAMHWVRQAPGKGLEWVSAITWNSGHVDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 320 - protein, 214 aa, Artificial Sequence
  recombinant TNF-alpha binder
DIQMTQSPSSLSASVGDRVTITCRTSMSIRNYLAWYQQKPGKAPKLLIYAASTLKKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 321 - protein, 120 aa, Artificial Sequence
  recombinant TNF-alpha binder
EVQLVESGGGLVQPGRSLRLSCAASGFTFDHFAMHWVRQAPGKGLEWVSAITWNSGHVDYADSVEGRFTISRDNAKNSLYLQMNSLRAEDTAVYYCAKVSYLSTASSLDYWGQGTLVTVS

SEQ ID NO: 322 - protein, 107 aa, Artificial Sequence
  recombinant TNF-alpha binder
DIQMTQSPSSLSASVGDRVTITCRTSMSIRNYLAWYQQKPGKAPKLLIYAASTLKKGVPSRFSGSGSGTDFTLTISSLQPEDVATYYCQRYDRPPYTFGQGTKVEIK

SEQ ID NO: 323 - protein, 224 aa, Artificial Sequence; identical to SEQ ID NO: 319
  recombinant TNF-alpha binder

SEQ ID NO: 324 - protein, 214 aa, Artificial Sequence
  recombinant TNF-alpha binder
DIQMTQSPSSLSASVGDRVTITCRASQRVRNYLAWYQQKPGKAPKLLIYAASWLKSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 325 - protein, 224 aa, Artificial Sequence; identical to SEQ ID NO: 319
  recombinant TNF-alpha binder

SEQ ID NO: 326 - protein, 214 aa, Artificial Sequence
  recombinant TNF-alpha binder
DIQMTQSPSSLSASVGDRVTITCRASQRVRNYLAWYQQKPGKAPKLLIYAASTLKKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 327 - protein, 224 aa, Artificial Sequence
  recombinant TNF-alpha binder
EVQLVESGGGLVQPGRSLRLSCAASGFTFDHFAMHWVRQAPGKGLEWVSAITWNSGHVDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 328 - protein, 214 aa, Artificial Sequence
  recombinant TNF-alpha binder
DIQMTQSPSSLSASVGDRVTITCHTSMGIRNYLAWYQQKPGKAPKLLIYAASWFQKGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 329 - protein, 224 aa, Artificial Sequence; identical to SEQ ID NO: 319
  recombinant TNF-alpha binder

SEQ ID NO: 330 - protein, 214 aa, Artificial Sequence
  recombinant TNF-alpha binder
DIQMTQSPSSLSASVGDRVTITCHASQRVRNYLAWYQQKPGKAPKLLIYAASTLKKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 331 - protein, 224 aa, Artificial Sequence
  recombinant TNF-alpha binder
EVQLVESGGGLVQPGRSLRLSCAASGFTFDHFAMHWVRQAPGKGLEWVSAITWNSGHIDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 332 - protein, 214 aa, Artificial Sequence
  recombinant TNF-alpha binder
DIQMTQSPSSLSASVGDRVTITCHTSMRVRNYLAWYQQKPGKAPKLLIYAASTLQKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 333 - protein, 224 aa, Artificial Sequence
  recombinant TNF-alpha binder
EVQLVESGGGLVQPGRSLRLSCAASGFTFDHFAMHWVRQAPGKGLEWVSAITWNSGHIDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVGPKSC

SEQ ID NO: 334 - protein, 214 aa, Artificial Sequence
  recombinant TNF-alpha binder
DIQMTQSPSSLSASVGDRVTITCHTSMGIRNYLAWYQQKPGKAPKLLIYAASTLQKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRVEC

SEQ ID NO: 335 - protein, 224 aa, Artificial Sequence
  recombinant TNF-alpha binder
EVQLVESGGGLVQPGRSLRLSCAASGFTFDDYAMHWVRQAPGKGLEWVSAITWNSGHVDYADSVEGRFTISRDNAKNSLYLQMNSLRAEDTAVYYCAKVKYLSTASQLDYWGQGTLVTVSSASTKGPSVFPLAPSSKSTSGGTAVLGCLVKDYFPEPVTVSWNSGALTSGVHTFPAVLQSSGLYSLSSVVTVPSSSLGTQTYICNVNHKPSNTKVDKKVEPKSC

SEQ ID NO: 336 - protein, 214 aa, Artificial Sequence
  recombinant TNF-alpha binder
DIQMTQSPSSLSASVGDRVTITCHTSMRVRNYLAWYQQKPGKAPKLLIYAASWLKKGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 337 - protein, 224 aa, Artificial Sequence
  recombinant TNF-alpha binder
EVQLVESGGGLVQPGRSLRLSCAASGFTFDDYAMHWVRQAPGKGLEWVSAITWNSGHVDYADSVEGRFTISRDNAKNSLYLQMNSLRAEDTAVYYCAKVKYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 338 - protein, 214 aa, Artificial Sequence
  recombinant TNF-alpha binder
DIQMTQSPSSLSASVGDRVTITCRASQRVRNYLAWYQQKPGKAPKLLIYAASWLKKGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 339 - protein, 224 aa, Artificial Sequence; identical to SEQ ID NO: 337
  recombinant TNF-alpha binder

SEQ ID NO: 340 - protein, 214 aa, Artificial Sequence; identical to SEQ ID NO: 326
  recombinant TNF-alpha binder

SEQ ID NO: 341 - protein, 224 aa, Artificial Sequence; identical to SEQ ID NO: 337
  recombinant TNF-alpha binder

SEQ ID NO: 342 - protein, 214 aa, Artificial Sequence; identical to SEQ ID NO: 332
  recombinant TNF-alpha binder

SEQ ID NO: 343 - protein, 224 aa, Artificial Sequence
  recombinant TNF-alpha binder
EVQLVESGGGLVQPGRSLRLSCAASGFTFDDYAMHWVRQAPGKGLEWVSAITWNSGHVDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 344 - protein, 214 aa, Artificial Sequence
  recombinant TNF-alpha binder
DIQMTQSPSSLSASVGDRVTITCRTSMRVRNYLAWYQQKPSKAPKLLIYAASTLQKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 345 - protein, 224 aa, Artificial Sequence
  recombinant TNF-alpha binder
EVQLVESGGGLVQPGRSLRLSCAASGFTFDDYAMHWVRQAPGKGLEWVSAITWNSGHVDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 346 - protein, 214 aa, Artificial Sequence
  recombinant TNF-alpha binder
DIQMTQSPSSLSASVGDRVTITCRTSMGIRNYLAWYQQKPGKAPKLLIYAASTLKKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 347 - protein, 224 aa, Artificial Sequence; identical to SEQ ID NO: 345
  recombinant TNF-alpha binder

SEQ ID NO: 348 - protein, 214 aa, Artificial Sequence
  recombinant TNF-alpha binder
DIQMTQSPSSLSASVGDRVTITCHTSMDIRNYLAWYQQKPGKAPKLLIYAASWFKSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 349 - protein, 224 aa, Artificial Sequence; identical to SEQ ID NO: 1
  recombinant TNF-alpha binder

SEQ ID NO: 350 - protein, 214 aa, Artificial Sequence; identical to SEQ ID NO: 330
  recombinant TNF-alpha binder

SEQ ID NO: 351 - protein, 224 aa, Artificial Sequence
  recombinant TNF-alpha binder
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVKYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 352 - protein, 214 aa, Artificial Sequence
  recombinant TNF-alpha binder
DIQMTQSPSSLSASVGDRVTITCHTSMRVRNYLAWYQQKPGKAPKLLIYAASTLKKGVPSRFSGSGSGTDFTLTISSLQPEDVATYYCQRYDRPPYTFGQGTKVEIKRTVAAPSVFIFPPSDEQLKSGTASVVCLLNNFYPRESKVQWKVDNALQSGNSQESVTEQDSKDSTYSLSSTLTLSKADYEKHKVYACEVTHQGLSSPVTKSFNRGEC

SEQ ID NO: 353 - protein, 224 aa, Artificial Sequence; identical to SEQ ID NO: 351
  recombinant TNF-alpha binder

SEQ ID NO: 354 - protein, 214 aa, Artificial Sequence
  recombinant TNF-alpha binder
DIQMTQSPSSLSASVGDRVTITCRTSMRVRNYLAWYQQKPGKAPKLLIYAASWLQKGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 355 - protein, 224 aa, Artificial Sequence; identical to SEQ ID NO: 78
  recombinant TNF-alpha binder

SEQ ID NO: 356 - protein, 214 aa, Artificial Sequence; identical to SEQ ID NO: 354
  recombinant TNF-alpha binder

SEQ ID NO: 357 - protein, 224 aa, Artificial Sequence; identical to SEQ ID NO: 351
  recombinant TNF-alpha binder

SEQ ID NO: 358 - protein, 214 aa, Artificial Sequence; identical to SEQ ID NO: 354
  recombinant TNF-alpha binder

SEQ ID NO: 359 - protein, 120 aa, Artificial Sequence
  recombinant TNF-alpha binder
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVKYLSTASQLDYWGQGTLVTVS

SEQ ID NO: 360 - protein, 107 aa, Artificial Sequence
  recombinant TNF-alpha binder
DIQMTQSPSSLSASVGDRVTITCRTSMRVRNYLAWYQQKPGKAPKLLIYAASWLQKGVPSRFSGSGSGTDFTLTISSLQPEDVATYYCQRYDRPPYTFGQGTKVEIK

SEQ ID NO: 361 - protein, 224 aa, Artificial Sequence; identical to SEQ ID NO: 351
  recombinant TNF-alpha binder

SEQ ID NO: 362 - protein, 214 aa, Artificial Sequence; identical to SEQ ID NO: 332
  recombinant TNF-alpha binder

SEQ ID NO: 363 - protein, 224 aa, Artificial Sequence; identical to SEQ ID NO: 147
  recombinant TNF-alpha binder

SEQ ID NO: 364 - protein, 214 aa, Artificial Sequence
  recombinant TNF-alpha binder
DIQMTQSPSSLSASVGDRVTITCRASQRLRNYLAWYQQKPGKAPKLLIYAASSTQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 365 - protein, 224 aa, Artificial Sequence
  recombinant TNF-alpha binder
EVQLVESGGGLVQPGRSLRLSCAASGFTFGDYAMHWVRQAPGKGLEWVSAITWNSGHVDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 366 - protein, 214 aa, Artificial Sequence
  recombinant TNF-alpha binder
DIQMTQSPSSLSASVGDRVTITCHTSMGIRNYLAWYQQKPGKAPKLLIRAASWLKSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRVEC

SEQ ID NO: 367 - protein, 224 aa, Artificial Sequence; identical to SEQ ID NO: 365
  recombinant TNF-alpha binder

SEQ ID NO: 368 - protein, 214 aa, Artificial Sequence
  recombinant TNF-alpha binder
DIQMTQSPSSLSASVGDRVTITCRTSMRVRNYLAWYQQKPGKAPKLLIYAASWLKSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 369 - protein, 224 aa, Artificial Sequence; identical to SEQ ID NO: 365
  recombinant TNF-alpha binder

SEQ ID NO: 370 - protein, 214 aa, Artificial Sequence
  recombinant TNF-alpha binder
DIQMTQSPSSLSASVGDRVTITCHTSMRVRNYLAWYQQKPGKAPKLLIYAASWLKSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 371 - protein, 224 aa, Artificial Sequence; identical to SEQ ID NO: 365
  recombinant TNF-alpha binder

SEQ ID NO: 372 - protein, 214 aa, Artificial Sequence
  recombinant TNF-alpha binder
DIQMTQSPSSLSASVGDRVTITCHTSMRVRNYLAWYQQKPGKAPKLLIYAASTLKSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 373 - protein, 224 aa, Artificial Sequence
  recombinant TNF-alpha binder
EVQLVESGGGLVQPGRSLRLSCAASGFTFGDYAMHWVRQAPGKGLEWVSAITWNSGHVDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 374 - protein, 214 aa, Artificial Sequence
  recombinant TNF-alpha binder
DIQMTQSPSSLSASVGDRVTITCHTSMRVRNYLAWYQQKPGKAPKLLIRAASTLKSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 375 - protein, 120 aa, Artificial Sequence
  recombinant TNF-alpha binder
EVQLVESGGGLVQPGRSLRLSCAASGFTFGDYAMHWVRQAPGKGLEWVSAITWNSGHVDYADSVEGRFTISRDNAKNSLYLQMNSLRAEDTAVYYCAKVSYLSTASSLDYWGQGTLVTVS

SEQ ID NO: 376 - protein, 107 aa, Artificial Sequence
  recombinant TNF-alpha binder
DIQMTQSPSSLSASVGDRVTITCHTSMRVRNYLAWYQQKPGKAPKLLIRAASTLKSGVPSRFSGSGSGTDFTLTISSLQPEDVATYYCQRYDRAPYTFGQGTKVEIK

SEQ ID NO: 377 - protein, 224 aa, Artificial Sequence; identical to SEQ ID NO: 373
  recombinant TNF-alpha binder

SEQ ID NO: 378 - protein, 214 aa, Artificial Sequence; identical to SEQ ID NO: 370
  recombinant TNF-alpha binder

SEQ ID NO: 379 - protein, 224 aa, Artificial Sequence
  recombinant TNF-alpha binder
EVQLVESGGGLVQPGRSLRLSCAASGFTFGDYAMHWVRQAPGKGLEWVSAITWNSGHIDYADSVEGRFTISRDNAKNSLYLQMNSLRAEDTAVYYCAKVKYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 380 - protein, 214 aa, Artificial Sequence
  recombinant TNF-alpha binder
DIQMTQSPSSLSASVGDRVTITCRTSMRVRNYLAWYQQKPGKAPKLLIYAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 381 - protein, 224 aa, Artificial Sequence; identical to SEQ ID NO: 379
  recombinant TNF-alpha binder

SEQ ID NO: 382 - protein, 214 aa, Artificial Sequence
  recombinant TNF-alpha binder
DIQMTQSPSSLSASVGDRVTITCHTSMRVRNYLAWYQQKPGKAPKLLIYAASTLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 383 - protein, 224 aa, Artificial Sequence; identical to SEQ ID NO: 379
  recombinant TNF-alpha binder

SEQ ID NO: 384 - protein, 214 aa, Artificial Sequence
  recombinant TNF-alpha binder
DIQMTQSPSSLSASVGDRVTITCHTSMRVRNYLAWYQQKPGKAPKLLIYAASTLKSGVPSRFSGSGSGTDFTLTISSPQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 385 - protein, 224 aa, Artificial Sequence; identical to SEQ ID NO: 214
  recombinant TNF-alpha binder

SEQ ID NO: 386 - protein, 214 aa, Artificial Sequence
  recombinant TNF-alpha binder
DIQMTQSPSSLSASVGDRVTITCHTSMRVRNYLAWYQQKPGKAPKLLIRAASTLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 387 - protein, 224 aa, Artificial Sequence; identical to SEQ ID NO: 373
  recombinant TNF-alpha binder

SEQ ID NO: 388 - protein, 214 aa, Artificial Sequence
  recombinant TNF-alpha binder
DIQMTQSPSSLSASVGDRVTITCHASQRVRNYLAWYQQKPGKAPKLLIRAASWLQSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQDSVTEQDSKDSTYSLSSTLTLSKADYEKHKVYACEVTHQGLSSPVTKSFNRGEC

SEQ ID NO: 389 - protein, 224 aa, Artificial Sequence; identical to SEQ ID NO: 373
  recombinant TNF-alpha binder

SEQ ID NO: 390 - protein, 214 aa, Artificial Sequence
  recombinant TNF-alpha binder
DIQMTQSPSSLSASVGDRVTITCHASQRVRNYLAWYQQKPGKAPKLLIRAASWLQSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 391 - protein, 224 aa, Artificial Sequence; identical to SEQ ID NO: 373
  recombinant TNF-alpha binder

SEQ ID NO: 392 - protein, 214 aa, Artificial Sequence
  recombinant TNF-alpha binder
DIQMTQSPSSLSASVGDRVTITCHASQGIRNYLAWYQQKPGKAPKLLIRAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 393 - protein, 224 aa, Artificial Sequence
  recombinant TNF-alpha binder
EVQLVESGGGLVQPGRSLRLSCAASGFTFGDYAMHWVRQAPGKGLEWVSAITWNSGHVDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 394 - protein, 214 aa, Artificial Sequence
  recombinant TNF-alpha binder
DIQMTQSPSSLSASVGDRVTITCRASQRVRNYLAWYQQKPGKAPKLLIRAASTLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 395 - protein, 224 aa, Artificial Sequence; identical to SEQ ID NO: 393
  recombinant TNF-alpha binder

SEQ ID NO: 396 - protein, 214 aa, Artificial Sequence
  recombinant TNF-alpha binder
DIQMTQSPSSLSASVGDRVTITCHASQRVRNYLAWYQQKPGKAPKLLIYAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 397 - protein, 224 aa, Artificial Sequence
  recombinant TNF-alpha binder
EVQLVESGGGLVQPGRSLRLSCAASGFTFGDYAMHWVRQAPGKGLEWVSAITWNSGHIDYADSVEGRFTISRDNAKNSLYLQMNSLRAEDTAVYYCAKVKYLSTASSLDYWGQGTLVTVSSASAKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 398 - protein, 214 aa, Artificial Sequence
  recombinant TNF-alpha binder
DIQMTQSPSSLSASVGDRVTITCRTSMRVRNYLAWYQQKPGKAPKLLIRAASTLKSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 399 - protein, 224 aa, Artificial Sequence; identical to SEQ ID NO: 379
  recombinant TNF-alpha binder

SEQ ID NO: 400 - protein, 214 aa, Artificial Sequence; identical to SEQ ID NO: 380
  recombinant TNF-alpha binder

SEQ ID NO: 401 - protein, 120 aa, Artificial Sequence
  recombinant TNF-alpha binder
EVQLVESGGGLVQPGRSLRLSCAASGFTFGDYAMHWVRQAPGKGLEWVSAITWNSGHIDYADSVEGRFTISRDNAKNSLYLQMNSLRAEDTAVYYCAKVKYLSTASQLDYWGQGTLVTVS

SEQ ID NO: 402 - protein, 107 aa, Artificial Sequence
  recombinant TNF-alpha binder
DIQMTQSPSSLSASVGDRVTITCRTSMRVRNYLAWYQQKPGKAPKLLIYAASWLQSGVPSRFSGSGSGTDFTLTISSLQPEDVATYYCQRYDRPPYTFGQGTKVEIK

SEQ ID NO: 403 - protein, 224 aa, Artificial Sequence
  recombinant TNF-alpha binder
EVQLVESGGGLVQPGRSLRLSCAASGFTFGDYAMHWVRQAPGKGLEWVSAITWNSGHVDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYICNVNHKPSNTKVDKKVEPKSC

SEQ ID NO: 404 - protein, 214 aa, Artificial Sequence
  recombinant TNF-alpha binder
DIQMTQSPSSLSASVGDRVTITCHTSMRVRNYLAWYQQKPGKAPKLLIYAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 405 - protein, 224 aa, Artificial Sequence
  recombinant TNF-alpha binder
EVQLVESGGGLVQPGRSLRLSCAASGFTFGDYAMHWVRQAPGKGLEWVSAITWNSGHVDYADSVEGRFTISRDNAKNSLYLQMNSLRAEDTAVYYCAKVKYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 406 - protein, 214 aa, Artificial Sequence; identical to SEQ ID NO: 396
  recombinant TNF-alpha binder

SEQ ID NO: 407 - protein, 224 aa, Artificial Sequence; identical to SEQ ID NO: 405
  recombinant TNF-alpha binder

SEQ ID NO: 408 - protein, 214 aa, Artificial Sequence
  recombinant TNF-alpha binder
NIQMTQSPSSLSASVGDRVTITCHASQRVRNYLAWYQQKPGKAPKLLIYAASTLKSGVPSRFSGSGSGTDFTLTISSLQPEDVATYYCQRYDRPPYTFGQGTKVEIKRTVAAPSVFIFPPSDEQLKSGTASVVCLPNNFYPREAKVQWKVDNALQSGNSQESVTEQDSKDSTYSLSSTLTLSKADYEKHKVYACEVTHQGLSSPVTKSFNRGEC

SEQ ID NO: 409 - protein, 224 aa, Artificial Sequence; identical to SEQ ID NO: 405
  recombinant TNF-alpha binder

SEQ ID NO: 410 - protein, 214 aa, Artificial Sequence
  recombinant TNF-alpha binder
DIQMTQSPSSLSASVGDRVTITCHTSMRVRNYLAWYQQKPGKAPKLLIYAASWLKSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 411 - protein, 224 aa, Artificial Sequence; identical to SEQ ID NO: 405
  recombinant TNF-alpha binder

SEQ ID NO: 412 - protein, 214 aa, Artificial Sequence; identical to SEQ ID NO: 324
  recombinant TNF-alpha binder

SEQ ID NO: 413 - protein, 224 aa, Artificial Sequence
  recombinant TNF-alpha binder
EVQLVESGGGLVQPGRSLRLSCAASGFTFGHFAMHWVRQAPGKGLEWVSAITWNSGHVDYADSVEGRFTISRDNAKNSLYLQMNSLRAEDTAVYYCAKVKYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 414 - protein, 214 aa, Artificial Sequence; identical to SEQ ID NO: 404
  recombinant TNF-alpha binder

SEQ ID NO: 415 - protein, 224 aa, Artificial Sequence; identical to SEQ ID NO: 413
  recombinant TNF-alpha binder

SEQ ID NO: 416 - protein, 214 aa, Artificial Sequence
  recombinant TNF-alpha binder
DIQMTQSPSSLSASVGDRVTITCRTSMRVRNYLAWYQQKPGKAPKLLIYAASWLQSGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 417 - protein, 224 aa, Artificial Sequence
  recombinant TNF-alpha binder
EVQLVESGGGLVQPGRSLRLSCAASGFTFGHFAMHWVRQAPGKGLEWVSAITWNSGHIDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 418 - protein, 214 aa, Artificial Sequence
  recombinant TNF-alpha binder
DIQMTQSPSSLSASVGDRVTITCHASQRVRNYLAWYQQKPGKAPKLLIYAASWLQSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 224 aa, Artificial Sequence; identical to SEQ ID NO: 417
  recombinant TNF-alpha binder

SEQ ID NO: 420 - protein, 214 aa, Artificial Sequence
  recombinant TNF-alpha binder
DIQMTQSPSSLSASVGDRVTITCRASQRVRNYLAWYQQKPGKAPKLLIRAASWLQSGVPSRFSGSGSGTDFTLTISSLQPEDVATYYCQRYDRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 421 - protein, 224 aa, Artificial Sequence
  recombinant TNF-alpha binder
EVQLVESGGGLVQPGRSLRLSCAASGFTFGHFAMHWVRQAPGKGLEWVSAITWNSGHVDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 422 - protein, 214 aa, Artificial Sequence
  recombinant TNF-alpha binder
DIQMTQSPSSLSASVGDRVTITCRTSMRVRNYLAWYQQKPGKAPKLLIRAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 423 - protein, 224 aa, Artificial Sequence
  recombinant TNF-alpha binder
EVQLVESGGGLVQPGRSLRLSCAASGFTFGHFAMHWVRQAPGKGLEWVSAITWNSGHIDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 424 - protein, 214 aa, Artificial Sequence
  recombinant TNF-alpha binder
DIQMTQSPSSLSASVGDRVTITCHTSMRVRNYLAWYQQKPGKAPKLLIRAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 425 - protein, 224 aa, Artificial Sequence
  recombinant TNF-alpha binder
EVQLVESGGGLVQPGRSLRLSCAASGFTFGHFAMHWVRQAPGKGLEWVSAITWNSGHVDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 426 - protein, 214 aa, Artificial Sequence
  recombinant TNF-alpha binder
DIQMTQSPSSLSASVGDRVTITCHTSMRVRNYLAWYQQKPGKAPKLLIYAASWLQSGVPSRFSGSGSGTDFTLTISSLQPEDVATYYCQRYNRPPYTFGQGTKVEIKRTVAAPSVFIFPPSDEQLKSGTASVVCLPNNFYPREAKVQWKVDNALQSGNSQESVTEQDSKDSTYSLSSTLTLSKADYEKHKVYACEVTHQGLSSPVTKSFNRGEC

SEQ ID NO: 427 - protein, 224 aa, Artificial Sequence
  recombinant TNF-alpha binder
EVQLVESGGGLVQPGRSLRLSCAASGFTFGHFAMHWVRQAPGKGLEWVSAITWNSGHIDYADSVEGRFTISRDNAKNSLYLQMNSLRAEDTAVYYCAKVKYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 428 - protein, 214 aa, Artificial Sequence; identical to SEQ ID NO: 396
  recombinant TNF-alpha binder

SEQ ID NO: 429 - protein, 224 aa, Artificial Sequence
  recombinant TNF-alpha binder
EVQLVESGGGLVQPGRSLRLSCAASGFTFGHFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 430 - protein, 214 aa, Artificial Sequence
  recombinant TNF-alpha binder
DIQMTQSPSSLSASVGDRVTITCHASQGIRNYLAWYQQKPGKAPKLLIRAASTLKSGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 431 - protein, 224 aa, Artificial Sequence; identical to SEQ ID NO: 429
  recombinant TNF-alpha binder

SEQ ID NO: 432 - protein, 214 aa, Artificial Sequence; identical to SEQ ID NO: 420
  recombinant TNF-alpha binder

SEQ ID NO: 433 - protein, 224 aa, Artificial Sequence; identical to SEQ ID NO: 351
  recombinant TNF-alpha binder

SEQ ID NO: 434 - protein, 214 aa, Artificial Sequence; identical to SEQ ID NO: 352
  recombinant TNF-alpha binder

SEQ ID NO: 435 - protein, 224 aa, Artificial Sequence; identical to SEQ ID NO: 351
  recombinant TNF-alpha binder

SEQ ID NO: 436 - protein, 214 aa, Artificial Sequence; identical to SEQ ID NO: 416
  recombinant TNF-alpha binder

SEQ ID NO: 437 - protein, 224 aa, Artificial Sequence; identical to SEQ ID NO: 57
  recombinant TNF-alpha binder

SEQ ID NO: 438 - protein, 214 aa, Artificial Sequence; identical to SEQ ID NO: 410
  recombinant TNF-alpha binder

SEQ ID NO: 439 - protein, 224 aa, Artificial Sequence; identical to SEQ ID NO: 1
  recombinant TNF-alpha binder

SEQ ID NO: 440 - protein, 214 aa, Artificial Sequence
  recombinant TNF-alpha binder
DIQMTQSPSSLSASVGDRVTITCRASQRVRNYLAWYQQKPGKAPKLLIRAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 441 - protein, 224 aa, Artificial Sequence; identical to SEQ ID NO: 57
  recombinant TNF-alpha binder

SEQ ID NO: 442 - protein, 214 aa, Artificial Sequence
  recombinant TNF-alpha binder
DIQMTQSPSSLSASVGDRVTITCHASQRVRNYLAWYQQKPGKAPKLLIYAASTLKSGVPSRFSGSGSGTDFTLTISSLQPEDVATYYCQRYDRPPYTFGQGTKVEIKRTVAAPSVFIFPPSDEQLKSGTASVVCLPNNFYPREAKVQWKVDNALQSGNSQESVTEQDSKDSTYSLSSTLTLSKADYEKHKVYACEVTHQGLSSPVTKSFNRGEC

SEQ ID NO: 443 - protein, 224 aa, Artificial Sequence; identical to SEQ ID NO: 57
  recombinant TNF-alpha binder

SEQ ID NO: 444 - protein, 214 aa, Artificial Sequence; identical to SEQ ID NO: 442
  recombinant TNF-alpha binder

SEQ ID NO: 445 - protein, 224 aa, Artificial Sequence
  recombinant TNF-alpha binder
EVQLVESGGGLVQPGHSLRLSCAASGFTFGHFAMHWVRQAPGKGLEWVSAITWNSGHVDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 446 - protein, 214 aa, Artificial Sequence; identical to SEQ ID NO: 390
  recombinant TNF-alpha binder

SEQ ID NO: 447 - protein, 224 aa, Artificial Sequence
  recombinant TNF-alpha binder
EVQLVESGGGLVQPGHSLRLSCAASGFTFGHFAMHWVRQAPGKGLEWVSAITWNSGHIDYADSVEGRFTISRDNAKNSLYLQMNSLRAEDTAVYYCAKVKYLSTASSLDYWGQGTLVTVSSASTKGPSVFPLAPSSKSTSGGTAALGCLVKDYFPEPVTVSWNSGAPTSGVHTFPAVLQSSGLYSLSSVVTVPSSSLGTQTYICNVNHKPSNTKVDKKVEPKSC

SEQ ID NO: 448 - protein, 214 aa, Artificial Sequence
  recombinant TNF-alpha binder
DIQMTQSPSSLSASVGDRVTITCHTSMRVRNYLAWYQQKPGKAPKLLIRAASTLQSGVPSRFSGSGSGTDFTLTISSLQPEDVATYYCQRYNRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 449 - protein, 224 aa, Artificial Sequence
  recombinant TNF-alpha binder
EVQLVESGGGLVQPGRSLRLSCVASGFTFGDYAMHWVRQAPGKGLEWVSAITWNSGHVDYADSVEGRFTISRDNAKNSLYLQMNSLRAEDTAVYYCAKVSYLSTASQLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 450 - protein, 214 aa, Artificial Sequence
  recombinant TNF-alpha binder
DIQMTQSPSSLSASVGDRVTITCRASQGIRNYLAWYQQKPGKAPKLLIYAASWLQSGVPSRFSGSGSGTDFTLTISSLQPEDVATYYCQRYDRPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 451 - protein, 224 aa, Artificial Sequence; identical to SEQ ID NO: 301
  recombinant TNF-alpha binder

SEQ ID NO: 452 - protein, 214 aa, Artificial Sequence; identical to SEQ ID NO: 302
  recombinant TNF-alpha binder

SEQ ID NO: 453 - protein, 120 aa, Artificial Sequence; identical to SEQ ID NO: 303
  recombinant TNF-alpha binder

SEQ ID NO: 454 - protein, 107 aa, Artificial Sequence; identical to SEQ ID NO: 304
  recombinant TNF-alpha binder

SEQ ID NO: 455 - protein, 224 aa, Artificial Sequence; identical to SEQ ID NO: 1
  recombinant TNF-alpha binder

SEQ ID NO: 456 - protein, 214 aa, Artificial Sequence; identical to SEQ ID NO: 2
  recombinant TNF-alpha binder

SEQ ID NO: 457 - protein, 470 aa, Artificial Sequence
  recombinant TNF-alpha binder
MEFGLRWVFLVAILKDVQCEVQLVESGGGLVQPGRSLRLSCAASGFTFDQFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 458 - protein, 236 aa, Artificial Sequence
  recombinant TNF-alpha binder
MDMRVPAQLLGLLLLWFPGARCDIQMTQSPSSLSASVGDRVTITCRASQGIRNYLAWYQQKPGKAPKLLIYAASWLQSGVPSRFSGSGSGTDFTLTISSLQPEDVATYYCQRYIQPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 459 - protein, 470 aa, Artificial Sequence
  recombinant TNF-alpha binder
MEFGLRWVFLVAILKDVQCEVQLVESGGGLVQPGRSLRLSCAASGFTFDGFAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 460 - protein, 236 aa, Artificial Sequence
  recombinant TNF-alpha binder
MDMRVPAQLLGLLLLWFPGARCDIQMTQSPSSLSASVGDRVTITCRASQGIRNYLAWYQQKPGKAPKLLISAAGWLQSGVPSRFSGSGSGTDFTLTISSLQPEDVATYYCQRYNQAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 461 - protein, 470 aa, Artificial Sequence
  recombinant TNF-alpha binder
MEFGLRWVFLVAILKDVQCEVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 236 aa, Artificial Sequence
  recombinant TNF-alpha binder
MDMRVPAQLLGLLLLWFPGARCDIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 224 aa, Artificial Sequence; identical to SEQ ID NO: 62
  recombinant TNF-alpha binder

SEQ ID NO: 464 - protein, 214 aa, Artificial Sequence
  recombinant TNF-alpha binder
DIQMTQSPSSLSASVGDRVTITCHASRKIRNYLAWYQQKPGKAPKLLIYAASSLLRGVPSRFSGSGSGTDFTLTISSLQPEDVATYYCQRYDKPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 465 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttgatcagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 466 - DNA, 643 bp, Artificial Sequence
  recombinant TNF-alpha binder
gatattcagatgacccagagcccgagcagcctgagcgcgagcgtgggcgatcgtgtgaccattacctgccgtgcgagccagggcattcgtaactatctggcctggtatcagcagaaaccgggcaaagcgccgaaactgctgatttatgcggcgagctggctgcagagcggtgtgccgagccgttttagcggcagcggtagcggcaccgattttaccctgaccattagcagcctgcagccggaagatgtggcgacctattattgccagcgttatatccagccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgct

SEQ ID NO: 467 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttgatcagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagc

SEQ ID NO: 468 - DNA, 321 bp, Artificial Sequence
  recombinant TNF-alpha binder
gatattcagatgacccagagcccgagcagcctgagcgcgagcgtgggcgatcgtgtgaccattacctgccgtgcgagccagggcattcgtaactatctggcctggtatcagcagaaaccgggcaaagcgccgaaactgctgatttatgcggcgagctggctgcagagcggtgtgccgagccgttttagcggcagcggtagcggcaccgattttaccctgaccattagcagcctgcagccggaagatgtggcgacctattattgccagcgttatatccagccgccgtatacctttggtcagggtaccaaagttgaaattaaa

SEQ ID NO: 469 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttggccagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 470 - DNA, 642 bp, Artificial Sequence
  recombinant TNF-alpha binder
gatattcagatgacccagagcccgagcagcctgagcgcgagcgtgggcgatcgtgtgaccattacctgccgcgcgagccagcgcctacgtaactatctggcctggtatcagcagaaaccgggcaaagcgccgaaactgctgattggcgcggcgagcagcaccattagcggtgtgccgagccgttttagcggcagcggtagcggcaccgattttaccctgaccattagcagcctgcagccggaagatgtggcgacctattattgccaacgttatattcagccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 471 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttggccagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagc

SEQ ID NO: 472 - DNA, 321 bp, Artificial Sequence
  recombinant TNF-alpha binder
gatattcagatgacccagagcccgagcagcctgagcgcgagcgtgggcgatcgtgtgaccattacctgccgcgcgagccagcgcctacgtaactatctggcctggtatcagcagaaaccgggcaaagcgccgaaactgctgattggcgcggcgagcagcaccattagcggtgtgccgagccgttttagcggcagcggtagcggcaccgattttaccctgaccattagcagcctgcagccggaagatgtggcgacctattattgccaacgttatattcagccgccgtatacctttggtcagggtaccaaagttgaaattaaa

SEQ ID NO: 473 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttggcgattatgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagccagctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagtggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 474 - DNA, 642 bp, Artificial Sequence
  recombinant TNF-alpha binder
gatattcagatgacccagagcccgagcagcctgagcgcgagcgtgggcgatcgtgtgaccattacctgccgtaccagcatgcgcgtgcgtaactatctggcctggtatcagcagaaaccgggcaaagcgccgaaactgctgatttatgcggcgagctggctgcagagcggtgtgccgagccgttttagcggcagcggtagcggcaccgattttaccctgaccattagcagcctgcagccggaagatgtggcgacctattattgccagcgttatgatcgtccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 475 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttggcgattatgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagccagctggattattggggccagggtaccctggttaccgttagc

SEQ ID NO: 476 - DNA, 321 bp, Artificial Sequence
  recombinant TNF-alpha binder
gatattcagatgacccagagcccgagcagcctgagcgcgagcgtgggcgatcgtgtgaccattacctgccgtaccagcatgcgcgtgcgtaactatctggcctggtatcagcagaaaccgggcaaagcgccgaaactgctgatttatgcggcgagctggctgcagagcggtgtgccgagccgttttagcggcagcggtagcggcaccgattttaccctgaccattagcagcctgcagccggaagatgtggcgacctattattgccagcgttatgatcgtccgccgtatacctttggtcagggtaccaaagttgaaattaaa

SEQ ID NO: 477 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttgatgattatgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagccagctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 478 - DNA, 642 bp, Artificial Sequence
  recombinant TNF-alpha binder
gatattcagatgacccagagcccgagcagcctgagcgcgagcgtgggcgatcgtgtgaccattacctgccgtaccagcatgcgcgtgcgtaactatctggcctggtatcagcagaaaccgggcaaagcgccgaaactgctgatttatgcggcgagctggctgcagaaaggtgtgccgagccgttttagcggcagcggtagcggcaccgattttaccctgaccattagcagcctgcagccggaagatgtggcgacctattattgccagcgttatgatcgtccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 479 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttgatgattatgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagccagctggattattggggccagggtaccctggttaccgttagc

SEQ ID NO: 480 - DNA, 321 bp, Artificial Sequence
  recombinant TNF-alpha binder
gatattcagatgacccagagcccgagcagcctgagcgcgagcgtgggcgatcgtgtgaccattacctgccgtaccagcatgcgcgtgcgtaactatctggcctggtatcagcagaaaccgggcaaagcgccgaaactgctgatttatgcggcgagctggctgcagaaaggtgtgccgagccgttttagcggcagcggtagcggcaccgattttaccctgaccattagcagcctgcagccggaagatgtggcgacctattattgccagcgttatgatcgtccgccgtatacctttggtcagggtaccaaagttgaaattaaa

SEQ ID NO: 481 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttgatcagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagcagcctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 482 - DNA, 642 bp, Artificial Sequence
  recombinant TNF-alpha binder
gatattcagatgacccagagcccgagcagcctgagcgcgagcgtgggcgatcgtgtgaccattacctgcaccgcgagccagcgcctgcgtaactatctggcctggtatcagcagaaaccgggcaaagcgccgaaactgctgatttatgcggcgagcagcacccagcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaaattgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 483 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttgatcagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagcagcctggattattggggccagggtaccctggttaccgttagc

SEQ ID NO: 484 - DNA, 321 bp, Artificial Sequence
  recombinant TNF-alpha binder
gatattcagatgacccagagcccgagcagcctgagcgcgagcgtgggcgatcgtgtgaccattacctgcaccgcgagccagcgcctgcgtaactatctggcctggtatcagcagaaaccgggcaaagcgccgaaactgctgatttatgcggcgagcagcacccagcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaaattgaaattaaa

SEQ ID NO: 485 - DNA, 672 bp, Artificial Sequence; identical to SEQ ID NO: 465
  recombinant TNF-alpha binder

SEQ ID NO: 486 - DNA, 642 bp, Artificial Sequence
  recombinant TNF-alpha binder
gatattcagatgacccagagcccgagcagcctgagcgcgagcgtgggcgatcgtgtgaccattacctgccgcgcgagccagcgcctacgtaactatctggcctggtatcagcagaaaccgggcaaagcgccgaaactgctgatttatgcggcgagcagcaccattagcggtgtgccgagccgttttagcggcagcggtagcggcaccgattttaccctgaccattagcagcctgcagccggaagatgtggcgacctattattgccaacgttatattcagccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 487 - DNA, 360 bp, Artificial Sequence; identical to SEQ ID NO: 467
  recombinant TNF-alpha binder

SEQ ID NO: 488 - DNA, 321 bp, Artificial Sequence
  recombinant TNF-alpha binder
gatattcagatgacccagagcccgagcagcctgagcgcgagcgtgggcgatcgtgtgaccattacctgccgcgcgagccagcgcctacgtaactatctggcctggtatcagcagaaaccgggcaaagcgccgaaactgctgatttatgcggcgagcagcaccattagcggtgtgccgagccgttttagcggcagcggtagcggcaccgattttaccctgaccattagcagcctgcagccggaagatgtggcgacctattattgccaacgttatattcagccgccgtatacctttggtcagggtaccaaagttgaaattaaa

SEQ ID NO: 489 - DNA, 672 bp, Artificial Sequence; identical to SEQ ID NO: 469
  recombinant TNF-alpha binder

SEQ ID NO: 490 - DNA, 642 bp, Artificial Sequence; identical to SEQ ID NO: 470
  recombinant TNF-alpha binder

SEQ ID NO: 491 - DNA, 360 bp, Artificial Sequence; identical to SEQ ID NO: 471
  recombinant TNF-alpha binder

SEQ ID NO: 492 - DNA, 321 bp, Artificial Sequence; identical to SEQ ID NO: 472
  recombinant TNF-alpha binder

SEQ ID NO: 493 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttggccagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagcagcctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 494 - DNA, 642 bp, Artificial Sequence
  recombinant TNF-alpha binder
gatattcagatgacccagagcccgagcagcctgagcgcgagcgtgggcgatcgtgtgaccattacctgcaccgcgagccagcgcctgcgtaactatctggcctggtatcagcagaaaccgggcaaagcgccgaaactgctgattggcgcggcgagcagcacccagcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaaattgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 495 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttggccagtttgcgatgcattgggtgcgtcaggccccgggcaaaggcctggaatgggtgagcgcgattacctggaacagcggccatattgattatgcggatagcgtggaaggccgttttaccattagccgtgataacgcgaaaaacagcctgtatctgcagatgaacagcctgcgtgcggaagataccgcggtgtattattgcgcgaaagtgaaatatctgagcaccgcgagcagcctggattattggggccagggtaccctggttaccgttagc

SEQ ID NO: 496 - DNA, 321 bp, Artificial Sequence
  recombinant TNF-alpha binder
gatattcagatgacccagagcccgagcagcctgagcgcgagcgtgggcgatcgtgtgaccattacctgcaccgcgagccagcgcctgcgtaactatctggcctggtatcagcagaaaccgggcaaagcgccgaaactgctgattggcgcggcgagcagcacccagcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaaattgaaattaaa

SEQ ID NO: 497 - DNA, 672 bp, Artificial Sequence; identical to SEQ ID NO: 493
  recombinant TNF-alpha binder

SEQ ID NO: 498 - DNA, 642 bp, Artificial Sequence
  recombinant TNF-alpha binder
gatattcagatgacccagagcccgagcagcctgagcgcgagcgtgggcgatcgtgtgaccattacctgcaccgcgagccagcgcctgcgtaactatctggcctggtatcagcagaaaccgggcaaagcgccgaaactgctgatttgggcggcgagcagcacccagcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaaattgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 499 - DNA, 360 bp, Artificial Sequence; identical to SEQ ID NO: 495
  recombinant TNF-alpha binder

SEQ ID NO: 500 - DNA, 321 bp, Artificial Sequence
  recombinant TNF-alpha binder
gatattcagatgacccagagcccgagcagcctgagcgcgagcgtgggcgatcgtgtgaccattacctgcaccgcgagccagcgcctgcgtaactatctggcctggtatcagcagaaaccgggcaaagcgccgaaactgctgatttgggcggcgagcagcacccagcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaaattgaaattaaa

SEQ ID NO: 501 - DNA, 672 bp, Artificial Sequence
  recombinant TNF-alpha binder
gaagttcagctggttgaaagcggcggtggtctggttcagccgggtcgtagcctgcgtctgagctgtgcggcgagcggctttacctttgatcatttcgcgatgcattgggtgcgtcaggccccgggcaaaggcctggaatgggtgagcgcgattacctggaacagcggccatgtggattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagcagcgcgagcaccaaaggcccgagcgtgtttccgctggccccgagcagcaaaagcaccagcggtggcaccgcagcgctgggttgcctggtgaaagattatttcccggaaccggtgaccgtgagctggaatagcggtgcgctgaccagcggcgtgcatacctttccggcggtgctgcagagcagcggcctgtatagcctgagttctgtggtgaccgttccgagcagcagcctgggcacccagacctatatttgcaacgtgaaccacaaaccgagcaacaccaaagtggataaaaaagtggaaccgaaaagctgc

SEQ ID NO: 502 - DNA, 642 bp, Artificial Sequence
  recombinant TNF-alpha binder
gatattcagatgacccagagcccgagcagcctgagcgcgagcgtgggcgatcgtgtgaccattacctgccgtaccagcatgagcattcgtaactatctggcctggtatcagcagaaaccgggcaaagcgccgaaactgctgatttatgcggcgagcaccctgaaaaaaggtgtgccgagccgttttagcggcagcggtagcggcaccgattttaccctgaccattagcagcctgcagccggaagatgtggcgacctattattgccagcgttatgatcgtccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 503 - DNA, 360 bp, Artificial Sequence
  recombinant TNF-alpha binder
gaagttcagctggttgaaagcggcggtggtctggttcagccgggtcgtagcctgcgtctgagctgtgcggcgagcggctttacctttgatcatttcgcgatgcattgggtgcgtcaggccccgggcaaaggcctggaatgggtgagcgcgattacctggaacagcggccatgtggattatgcggatagcgtggaaggccgttttaccattagccgtgataacgcgaaaaacagcctgtatctgcagatgaacagcctgcgtgcggaagataccgcggtgtattattgcgcgaaagtgagctatctgagcaccgcgagcagcctggattattggggccagggtaccctggttaccgttagc

SEQ ID NO: 504 - DNA, 321 bp, Artificial Sequence
  recombinant TNF-alpha binder
gatattcagatgacccagagcccgagcagcctgagcgcgagcgtgggcgatcgtgtgaccattacctgccgtaccagcatgagcattcgtaactatctggcctggtatcagcagaaaccgggcaaagcgccgaaactgctgatttatgcggcgagcaccctgaaaaaaggtgtgccgagccgttttagcggcagcggtagcggcaccgattttaccctgaccattagcagcctgcagccggaagatgtggcgacctattattgccagcgttatgatcgtccgccgtatacctttggtcagggtaccaaagttgaaattaaa

SEQ ID NO: 505 - DNA, 672 bp, Artificial Sequence; identical to SEQ ID NO: 481
  recombinant TNF-alpha binder

SEQ ID NO: 506 - DNA, 642 bp, Artificial Sequence
  recombinant TNF-alpha binder
gatattcagatgacccagagcccgagcagcctgagcgcgagcgtgggcgatcgtgtgaccattacctgccgcgcgagccagggcctgcgtaactatctggcctggtatcagcagaaaccgggcaaagcgccgaaactgctgatttatgcggcgagcagcaccattcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaagttgaaattaaacgtaccgtggcagcgccgagcgtgttcatttttccgccgagcgatgaacagctgaaaagcggcaccgcgagcgtggtgtgcctgctgaacaacttttatccgcgtgaagcgaaagtgcagtggaaagtggataacgcgctgcagagcggcaacagccaggaaagcgttaccgaacaggatagcaaagatagcacctacagcctgagcagcaccctgaccctgagcaaagcggattacgaaaaacacaaagtgtatgcgtgcgaagtgacccatcagggcctgagcagcccggttaccaaatcttttaaccgtggcgaatgc

SEQ ID NO: 507 - DNA, 360 bp, Artificial Sequence; identical to SEQ ID NO: 483
  recombinant TNF-alpha binder

SEQ ID NO: 508 - DNA, 321 bp, Artificial Sequence
  recombinant TNF-alpha binder
gatattcagatgacccagagcccgagcagcctgagcgcgagcgtgggcgatcgtgtgaccattacctgccgcgcgagccagggcctgcgtaactatctggcctggtatcagcagaaaccgggcaaagcgccgaaactgctgatttatgcggcgagcagcaccattcgcggtgtgccgagccgttttagcggcagcggtagcggcaccgattttaccctgaccattagcagcctgcagccggaagatgtggcgacctattattgccagcgttatattcagccgccgtatacctttggtcagggtaccaaagttgaaattaaa

SEQ ID NO: 509 - DNA, 672 bp, Artificial Sequence; identical to SEQ ID NO: 465
  recombinant TNF-alpha binder

SEQ ID NO: 510 - DNA, 642 bp, Artificial Sequence; identical to SEQ ID NO: 486
  recombinant TNF-alpha binder

SEQ ID NO: 511 - DNA, 360 bp, Artificial Sequence; identical to SEQ ID NO: 467
  recombinant TNF-alpha binder

SEQ ID NO: 512 - DNA, 321 bp, Artificial Sequence; identical to SEQ ID NO: 488
  recombinant TNF-alpha binder

SEQ ID NO: 513 - DNA, 672 bp, Artificial Sequence; identical to SEQ ID NO: 465
  recombinant TNF-alpha binder

SEQ ID NO: 514 - DNA, 643 bp, Artificial Sequence; identical to SEQ ID NO: 466
  recombinant TNF-alpha binder

SEQ ID NO: 515 - DNA, 360 bp, Artificial Sequence; identical to SEQ ID NO: 467
  recombinant TNF-alpha binder

SEQ ID NO: 516 - DNA, 321 bp, Artificial Sequence; identical to SEQ ID NO: 468
  recombinant TNF-alpha binder

The invention claimed is:

1. An isolated antibody or antigen binding portion capable of binding TNF-α, wherein:
   the $V_H$ antibody chain comprises SEQ ID NO:20, excluding sequences identified by SEQ ID NO: 40; and
   the $V_L$ (variable light chain) antibody chain comprises at least one of the $V_L$ CDR1, CDR2 and CDR3 regions whose sequences are identified by SEQ ID NO: 49, 50 and 51, respectively.

2. An isolated antibody or antigen binding portion capable of binding TNF-α, wherein:
   the $V_L$ antibody chain comprises SEQ ID NO:27, excluding the sequence identified by SEQ ID NO: 42; and
   the $V_H$ (variable heavy chain) antibody chain comprises at least one of the $V_H$ CDR1, CDR2 and CDR3 regions whose sequences are identified by SEQ ID NO: 43, 44, and 45, respectively.

3. A pharmaceutical composition, comprising an isolated antibody or antigen binding portion thereof capable of binding TNF-α wherein:
   the $V_L$ (variable light chain) antibody chain comprises at least one of the $V_L$ CDR1, CDR2 and CDR3 regions whose sequences are identified by SEQ ID NO: 49, 50 and 51; and
   wherein the $V_H$ antibody chain comprises SEQ ID NO:291, excluding an isolated antibody or antigen binding portion thereof capable of binding TNF-α which comprises a $V_H$ antibody chain comprising at least one of the $V_H$ CDR1, CDR2 and CDR3 regions whose sequences are identified by SEQ ID NO: 46, 47, and 48 respectively and which comprises a $V_L$ antibody chain comprising at least one of the $V_L$ CDR1, CDR2 and CDR3 regions whose sequences are identified by SEQ ID NO: 52, 53 and 54, respectively.

4. A pharmaceutical composition, comprising an isolated antibody or antigen binding portion thereof capable of binding TNF-α, wherein the $V_L$ antibody chain comprises SEQ ID NO:292; and the $V_H$ (variable heavy chain) antibody chain comprises at least one of the $V_H$ CDR1, CDR2 and CDR3 regions whose sequences are identified by SEQ ID NO: 43, 44, and 45.

5. The pharmaceutical composition of claim 4, wherein the $V_H$ antibody chain comprises SEQ ID NO:291.

6. An isolated antibody or antigen binding portion of the isolated antibody, wherein:
   the $V_L$ (variable light chain) antibody chain comprises at least one of the $V_L$ CDR1, CDR2 and CDR3 regions whose sequences are identified by SEQ ID NO: 49, 50 and 51; and
   the $V_H$ antibody chain comprises SEQ ID NO:291,
   excluding an isolated antibody or antigen binding portion thereof capable of binding TNF-α which comprises a $V_H$ antibody chain comprising at least one of the $V_H$ CDR1, CDR2 and CDR3 regions whose sequences are identified by SEQ ID NO: 46, 47, and 48 respectively and which comprises a $V_L$ antibody chain comprising at least one of the $V_L$ CDR1, CDR2 and CDR3 regions whose sequences are identified by SEQ ID NO: 52, 53 and 54, respectively.

7. An isolated antibody or antigen binding portion of the isolated antibody, wherein:
   the $V_H$ (variable heavy chain) antibody chain comprises at least one of the $V_H$ CDR1, CDR2 and CDR3 regions whose sequences are identified by SEQ ID NO: 43, 44, and 45, respectively; and
   the $V_L$ antibody chain comprises SEQ ID NO:292.

8. The isolated antibody or antigen binding portion of the isolated antibody of claim 7, wherein the $V_H$ antibody chain comprises SEQ ID NO:291.

9. The isolated antibody or antigen binding portion thereof of claim 2, wherein the $V_H$ antibody chain comprises SEQ ID NO:20, excluding sequences identified by SEQ ID NO: 40.

10. A pharmaceutical composition comprising an isolated antibody or antigen binding portion capable of binding TNF-α, wherein:
    the $V_H$ antibody chain comprises SEQ ID NO:20, excluding sequences identified by SEQ ID NO: 40; and
    the $V_L$ (variable light chain) antibody chain comprises at least one of the $V_L$ CDR1, CDR2 and CDR3 regions whose sequences are identified by SEQ ID NO: 49, 50 and 51, respectively.

11. A pharmaceutical composition comprising an isolated antibody or antigen binding portion capable of binding TNF-α, wherein:
    the $V_L$ antibody chain comprises SEQ ID NO:27, excluding the sequence identified by SEQ ID NO: 42; and
    the $V_H$ (variable heavy chain) antibody chain comprises at least one of the $V_H$ CDR1, CDR2 and CDR3 regions whose sequences are identified by SEQ ID NO: 43, 44, and 45, respectively.

12. The pharmaceutical composition of claim 11, wherein the $V_H$ antibody chain comprises SEQ ID NO:20, excluding sequences identified by SEQ ID NO: 40.

* * * * *

UNITED STATES PATENT AND TRADEMARK OFFICE
CERTIFICATE OF CORRECTION

PATENT NO. : 8,399,627 B2 Page 1 of 1
APPLICATION NO. : 12/808608
DATED : March 19, 2013
INVENTOR(S) : Votsmeier et al.

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 142 days.

Signed and Sealed this
First Day of September, 2015

Michelle K. Lee
*Director of the United States Patent and Trademark Office*